United States Patent 7,892,730 (COMPOSITIONS AND METHODS FOR CANCER) - sequence listing, part 19

SEQ ID NO: 2021 - DNA, 3885 bp, Homo sapiens
atgttccgcttccctatggggctcctgcttggctctgtgctcctggtggcttcggccccagccactctggagcctcccggctgcagcaacaaggagcaacaggtcactgtcagccacacctacaagatcgatgtgcccaagtctgccttggttcaggttgacgctgaccctcagcccctcagtgacgatggggcttcgctcttggccctgggggaggccagggaggaacagaacatcatcttcaggcacaacatccgccttcagacgccacagaaggactgcgagttggcaggcagtgtccaggacctcctggcccgggtgaagaagctggaggaagagatggtggagatgaaggaacagtgtagtgcccagcgctgctgccagggagtcactgatctaagccgccactgcagcggccacgggaccttctccctggagacctgcagctgccactgcgaagagggcagggagggccccgcctgcgagcggctggcctgccccggggcgtgcagcggccacgggcgttgcgtggacgggcgctgcctgtgccatgagccctacgtgggtgccgactgcggctacccggcctgccctgagaactgcagcggacacggcgagtgcgtgcgcggcgtgtgccagtgccacgaagacttcatgtcggaggactgcagcgagaagcgctgtcccggcgactgcagcggccacggcttctgtgacacgggcgagtgctactgcgaggagggcttcacaggcctggactgtgcccaggtggtcaccccacagggcctgcagctgctcaagaacacggaggattctctgctggtgagctgggagccctccagccaggtggatcactacctcctcagctactaccccctggggaaggagctctctgggaagcagatccaagtgcccaaggagcagcacagctatgagattcttggtttgctgcctggaaccaagtacatagtcaccctgcgtaacgtcaagaatgaagtttctagcagcccacagcatctacttgccaccacagaccttgctgtgcttggcactgcctgggtgacagatgagactgagaactcccttgacgtggagtgggaaaacccctcaactgaggtggactactacaagctgcgatatggccccatgacaggacaggaggtagctgaggtcactgtgcccaagagcagtgaccccaagagccgatatgacatcactggtctgcacccggggactgagtataagatcacggtggtgcccatgagaggagagctggagggcaagccgatcctcctgaatggcaggacagaaattgacagtccaaccaatgttgtcactgatcgagtgactgaagacacagcaactgtctcctgggacccagtgcaggctgtcatagacaagtatgtagtgcgctacacttctgctgatggggacaccaaggaaatggcagtgcacaaggatgagagcagcactgtcctgacgggcctgaagccaggagaggcatacaaggtctacgtgtgggctgaaaggggcaaccaggggagcaagaaagctgacaccaatgccctcacagaaattgacagcccagcaaacctggtgactgaccgggtgactgagaataccgccaccatctcctgggacccggtacaggccaccattgacaagtacgtggtgcgctacacctctgctgacgaccaagagaccagagaggttctggtggggaaggagcagagcagcactgtcctgacaggcctgaggccaggtgtggagtacacagtgcatgtctgggcccagaagggggaccgagagagcaagaaggctgacaccaacgccccgacagatattgacagccccaaaaacctggtgactgaccgggtgacagagaatatggccacggtctcctgggacccggtgcaggccgccattgacaagtacgtggtgcgctacacctctgctggtggagagaccagggaggttccggtggggaaggagcagagcagcacagtcctgacaggcctgagaccgggtatggagtacatggtgcacgtgtgggcccagaagggggaccaggagagcaagaaggccgacaccaaggcccagacagacattgacagcccccaaaacctggtgaccgaccgggtgacagagaatatggccactgtctcctgggacccggtgcgggccaccattgacaggtatgtggtgcgctacacctctgccaaggacggagagaccagggaggttccggtggggaaggagcagagtagcactgtcctgacgggcctgaggccgggtgtggagtacacggtgcacgtgtgggcccagaagggggcccaggagagcaagaaggctgacaccaaggcccagacagacattgacagcccccaaaacctggtcactgactgggtgacagagaatacagccactgtctcctgggacccggtgcaggccaccattgacaggtatgtggtgcactacacgtctgccaacggagagaccagggaggttccagtggggaaggagcagagcagcactgtcctgacgggcctgaggccgggcatggagtacacggtgcacgtgtgggcccagaaggggaaccaggagagcaagaaggctgacaccaaggcccagacagaaattgacggccccaaaaacctagtgactgactgggtgacggagaatatggccactgtctcctgggacccggttcaggccaccattgacaagtacatggtgcgctacacctctgctgacggagagaccagggaggttctggtggggaaggagcacagcagcactgtcctgatgggcctgagaccaggcatggagtacatggtgcacgtgtgggcccagaagggggcccaggagagcaagaaggctgacaccaaggcccagacagaactcgaccctcccagaaaccttcgtccatctgctgtaacgcagtctggtggcatattgacctggacgcccccctctgctcagatccacggctacattctgacttaccagttcccagatggcacagttaaggagatgcagctgggacgggaagaccagaggtttgcgttgcaaggccttgagcaaggcgccacctaccctgtctcccttgttgcctttaagggtggtcgccggagcagaaatgtatccaccaccctctccacagttggtgcccgtttcccacacccttcggactgcagtcaggttcagcagaacagcaatgccgccagtggtctgtacaccatctacctgcatggcgatgccagccggcccctgcaggtgtactgtgacatggaaacggacggaggtggctggattgtcttccagaggcggaacactgggcagctggatttcttcaagcgatggaggagctatgtggaaggctttggggaccccatgaaggagttctggcttggacttgacaagctacacaacctcaccaccggcactccagcgcggtatgaggtgagagtggatttacagactgccaatgaatctgcctatgctatatatgatttcttccaagtggcctccagcaaggagcggtataagctgacagttgggaaatacagaggcacggcaggggatgctcttacttaccacaatggatggaagtttacaacttttgacagagacaacgatatcgcactcagcaactgtgccctgacacatcatggtggctggtggtataagaactgccacttggccaaccctaatggcagatatggggagaccaagcacagtgagggggtgaactgggagccttggaaaggacatgaattctccattccttacgtggagttgaaaatccgccctcatggctacagcagggagcctgtcctgggcagaaagaagcggacgctgagaggaaggctgcgaacgttctga

SEQ ID NO: 2022 - protein, 1294 aa, Homo sapiens [sequence omitted]

SEQ ID NO: 2023 - DNA, 36383 bp, Mus musculus
  misc_feature (1)...(36383): n = A,T,C or G
ggacagggcaccttttcactgtcgggttatgattctttagttctttggcaaaagttttgggatcatcttgccacactacagaccaaggtgctattgcagtcttaattaataaatatacagtgtccatctgtgggcatggcagtcattttttttttttttagtattctgttgtcctgtgtagcccagattgacttagaatttgcttatcttctgccctcagcttcctgagttctgggattgcaggtaggcaataccacaccaagatgtataatattatttttttgttaaccttttatgcatagagtcaaaaaatctcagatggtatacttgggttaagtaatgtgatcttccttgaatttctttatactagatttagataaatattaattcatagtataataaagttcttttctttattacttactagtatctatgaaggagctctagttttttctctttttttggttttggattcatagttcagaaattaattttagcacagaatgtagcagctgaaaaggaatttttatgaggttgtctgagcgtatgaagttacctgatgatgactctctatagaagcttcgtggggaacctctgaggccaggagacagaatggcagcttggactgcagggccacagcttccatgcttggtgcatttgatttgattttgtgcccacagtgcacatatgtgtgcagttgcacacacatgcacatggaggcagactttgggtgtccttccttaggcacactgtccactttagtttttgagacagtctctccctggctcggaactcactgagtatgctacactagctagctagtgaaccctggaatctgcctagccctggctggggatcaaactcatgtcctcaggcttaccaagcaagcacattatcaactgaactatctccctagccccagtacatctagttggaactatagcattggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccccctccctggccctggcgttcccctgtactggggcatataaagtttgcaagtccaatggacctctctttgcagtgatggccgactaggccatcttttgatacatatgcaagaactccggggtactggttagttcatattgttgttccacctatagggttgcagttccctttagcgagaaattttttaaattaaagtaatgctttttgagtgatacaatcccaaattttagtttttgagagctggcagtttctgtgggtaagacacacagcagcccattaagttaactgtcagcaccaacagcttgaatgttcttgttcatccttcaggttctcagaatttgtctgtgaacttcagtgaagagagttgggaagcaaaaacattgtgatgtagtttattgatatgaggataacaggttaataactaaagttcattattctctcctattgatttcatgtgtgtttggaaaagcagtttggctctacagtgaatgcaaatataaacaccctcagcctgacaggtgtgctccatttagagagaaataccttgtacgacatttgtttcttttgatttctatgctaggcccactttaactgtaactttttcaatggggagagtctcctttgagagtacatgtttttctggcatagtttatccccatataaagttcttagtaatcccaacccttataaaaatagcttttgcaatgcgattggggaaagaggtccctggaaacaactgtctgaggctctaaaaattttatgatcggatgttaaaagtgccatgctagaatcaaaataggtcatgtgccttgactacatctgcatggctacccacttgggaaaacacgtctccattttctcggcactctcacatgtcaaggtagactgcaaacaggtcaaagtacgggactgccatccgtgatttggttttcccagaagttctctcaagttgtctggcagggtcccagaagatacacagttctctcctcctattggcaactcagtcattttaggaaaaaataaagattttatggagatttttactaagaggagcttttttttttttttttgcataattcatctttaaggaaaggacctttccaaaatgatctccaggaaatcagtgttcatctgaacattggcactggtctcaagttttgagaggttccttacctcctggtaccttctgacctttctttctggtaccttctgacctttctttctgagcagtagctcatcagttgtatcatagtggtagtggtgatacctacatttaccagtcgtgatcgtgtgtgtgtgtgtgtgtgtgtgtgtgtgcgtgcgcacgtgtgtgtgtgtgtgtgtgtgtgtgcgcgcacgcgcgcgcgtgcgagtggtctccgctctagacaggacctcatgtagcccaggctgtcctaagaagctaaggatgaccttgaactgctgaccttcccctcttcctccccagtgtcagaattacagctgaggaacaccatgcctgagctcatttgtttcttaaaatatttgattaatgatccttggcaacaggaaagtctgtgtgctttctgtgcctataagtacagggccacataatcctgcaaaccaataagaacggcaaaccacagctaagaagccgtgttgagtttaacaatgtcttattagtgaaattgtaaaagaaaagagggtgagcttgttgcctgctggcattttactacttaggatgtaataatctagtaatggtcccttaacatttgctgccacctacgtgagggttaatttcccgagattaactattttccccctgagataatggttttcccagccaaaaagcaacacggtaaggtaggtctgcaccacggagccgagccatcccacctgtcttgctgcctagcccactctctctttcatgctgtagccctttcttgtgttccagttgccacaggcatggctgcatgtgtgtgtgcatgcacatgtgcacgcgcacgtggacatacacacacacacacaaaacctggaacagtcacccagactagaatacctttttcggtacaagcacctctgaaaagtgccactgcccaatgcagtgactgtttttcgtgacatcaagacaccttttggctgtcaccccatccacaggaaccctcagaatcctctgaattttgtcctcagtgcactgaaacactgggaaaattttaaatgtgaatgtgagactaagcttggaatatcgagtcctttgttggcagtgaatgccaaaaaatgactttgtgtgggtttggttaccataaaaagaaatcccagtgaataaaatgataaatagctgttttcttttcatataagaattgctctgctattgaattttttggcatattaatcaattggggaaaactggtatttactgacatgctttttgaaaatttgataaatgggtgtatatgatcagaaagaaataatctagttgtaagttaccaagtttatagaacttcatggctttaagcagacctatgtcaagaaagttaaattcaaatcctgaaatatgcaatggtacatttgatttttgaaataatactagtttccataatatttcctggactcaaataaatttaatttattttatgtgaattttctccctattatactttcctccctaacatactctaatattaataaaatgttttcccatttatgactattatcatacactttagtaataaaaaacaaaccaaagaatttctgtttcttttggaaagctaaacctcttagtaaaatatcaagtaacaacaacaacaacaaacaaacaaacaaacaaccccatgtctttatcaaatgctaggtttcactttgaaagtcttgtggtctttagagggccttcctttccttggcttacatgaaggaaaacagcaggggaactgttgagtctcctcagagccggccttgggagtaagagaagactgcaccacatgtagtccattgccagtactttctatcacgtttcctttcacagccacgataaagtgactcacgacaggccgttcatacatccctccatgtctatagtatctgtcaatgtgatcctgaagttcctgagggacccagcacgttttgccctttcccacctttcctgtctcaggaagatccagtgacttatgagtaacagggagtttgcccccacccccaatggcacctgaaagaaggatgtaaaatcaaaatttaaaaatcatacataaaaggttcatttggaatggaacttgttcctaatttcataggggtgtgtgtgtgtgtgtgtgtgtgtgtgtgtgtgtgttttacatacatgttgagtgtataaatgtatgcgccttgatttttgcatggatcctggatgtgggggttgaacttgggttctcagacctgccaagcaagcacttttagcctactgagttaccacactagcccctctgtattagcagtctcgagcatttcactggaacgagggctgactctgctatagatgaacgtggatcagagcatcctgggcctgggaggcccacacagctcttcctgaaggacctgggagtaagaaggaagtcctgggaaatggtgttaactcctggattaaatagtcgagcagcgagcaagcatcaattgaaaggcgcttatccagaaagtctgcctttgaattgtatatggtgctttctctcctcattctgaaatctattttcagaatagacctattctttgataggagttttatttggtttgtctgttttgtgttttgtcctcagtaaggatgaatggtatgtgtctagtcactggttttaattgagtgctgtaaaacgtaatggtagctgtctgatttagaaagataactatctcgtcagatgaaaacattagtacattatagcctttcttttcaagaaattctgtccttacttcacttgaagtttctgctatagcaaaattacatattctgtgtcatacaaagaataggaagtgataaatgctaattttcacttctgaggttcatattttcctttaaagtaatgatcgctaaagaacaaaggcaagcaatttgtcttgacagtttctcatattctcctaaggagctgcctaagtcatagttcaaacactatttaaattatggagttattccctaagaagtcacaaagaaaagtggccattttctttatctccaatgtgagatattttcttctagagagttcaaaacttgaggatttaaagtaagtgaaaatttgggactaggtgaaaatacttagagaagaacattgaagatataggaattattaagttttgataagacattggagtgtgaagatgaaatgactagtgttcagaggtcagccaagtaggatttcagtccctaccctcagtctcctgatgtctttctcctcggtggaacaggagtagtaggtctacagcctataagaacaaagataacatacatgcaatcttttgcattttaattgtgttggtgtaaaaaaaatgtatcaaaaaattcaggtgacagcagatgctggtgaggatgtggagaaagaggaacactcctccattgttggtgggattgcaagcttgtacaaccactctggaaatcagtctggcggttcctcagaaaattggacatagtactaccggaggatcccgcaatacctctcctgggcgtatatccagaagatgttccaactagtaagaaagatatattctccactatgttcatagcagccttatttataatagccagaagctggaaagaacccagatgtccctcaacagaggaatggatacaaaaaatgtggtacatttacagaatggagtactactcagctattaaaaagaatgaatttatgaaattcctaggcaaatggttggacctggaggacatcatcctgagtgaggtaacccaatcacaaaagaactcacatgatatgtactcagtggatattagcccagaaacttagaatacccaagatataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgggaacaaaacacccatggtaagaagttacagagacaaagtttggagctgagtacaaaaggatggaccatctagagactgccatatccagggatccatcccataatcagcctccaaacgctgacaccattgcatacactagcaagattttgctgaaaggacccagatatagctgtctcttgtgagactatgccggggcctagcaaacacagaagtggatgctcacagtcagctattggatggatcacagggctcctaatggaggagctagagaaagtacccaaggagctaaagggaactgcaaacctataggtggaacaacattatgaactaaccagtacccccggagctcttgactctagctgcatatgtatcaaaagatggcctagtcagccatcactggaaagagaggcccattggacatgcaaactttatatgccccagtacaggggaacgccagggccaaaaagtgggagtgggtgggtaggggagtggggggtggggtatggagggacttttgggatagcattggaaatgtaaatgaggaaaatacctaataaaaaataaaaacaaaaaacaaaaaacaaacaaatgtatcatgagtggcagctagtgttgagacttcctcactctaagtgctcaggaccagttcagcagtattagcttatttttttttaatttgagaatatttgaaactatctatctctctatatatctctatctgtctatatctgtacctataatttatatctctctctataatcatatctatttatatatattgcatacatatgtacactatacacacacacacctagatatctggaagtccaagtgtaaattcatttatgtgcataaaatagagtagaatatagcttgaagataatgcttatagtacttttagtgtatctgccttttgagtggaactcaccaggtatggaactttacctctgggcatcatgttggtgctcagaggtttcttcgtggctctgtttcctctgtgagtcacattttagtagtctacatacacattgctttgtgcacgtgtacaaacaaatcctcaaaggtagcttattcagcacagggatttctcagctgcacgtcagctgctttgttgcagtcagcattaccacacaggctacggtggagacaccaccacttgcagctgattggtgagatttatcttcacagcctcgggatccacggggtgggccctacattgatgatcccttgatggaagtccaggattcatgtaaattctcaacaccatgttcccctcctcctgagctgagctggtcactctcctctgacagactccttcactcttctgcaatgcaagtattatgaaagcaaacaatccatttaaatattcaaatcctagatactgtttttaacactactattttcaaattttgacatctaagaaattagcagtgagttaatcatatttaaatatctaaaagctttgctcacacacatgcttgcacgtgcacacactcatacacacagtagtcttggcaaatataacaatcagtatttaaaactttaactagatttaagttgttatataaaacaaaattaatccaattaacggggtgaacattcagtactgcaaacactgtgcagtttaaatccagctcaggatcatttttgaagttttagttgtggtcagtatttttctccctatatcagagcattttgctcctaacctcccttaataaccagcgatcacattagattccacacaggcacattatatggttcccccccccgccacatacccacccccccgtgcgtgtgtgtgtctgtctgtttgtctgtctgtctctgtcatttcacttcctgtaatcatcttcagttatatgacagtgcagataatgagactccatcttctgtgtgtccgtgtttgtgtgtgtgtgtgtgtacatgtgtgtgcacatgtgcatgtgcaggctaggagaggcaacagtcttcatcagccaccccctactttgtttttgtctttttgagatgggggctctcgtggaatttggaacttgcctgttcagcaagactagctatccaatcatgtgcctgtctcttctcaagactcaaattcattctcatgtgacaagcacttttccaaacgagccatcccaaaagccccctaattttcnnnnnnnnnnnnnnnnnnnnnnnnnnnnnnnnnnnnnnnnnnnnnnntactggtatttgcctactctagcttttttttaaaaaaaaaatacacacacatacacacacacacatacacacacatacacacacacacacacacacacacacacacacacacacacacacacacacatatatatctatcacatccctcaacctcctgaacttttgcagtaaaggaagcaatggctcagctctcactactcctgctgcgactcagcataaggcctagcactcggatagcacattggaaaatagtccttgcgtgtagcattgtaacttttctccttagtgaaaggaacattagactttctatatttgtataataatgctatcctttgatggaatggctttttcctaatggcgtttgttttgtacgcaggaagcgtcaggacaatcatgcccatgagaactctcaactgttcaggtaattgtcgtgtttaaatgaccctttaaactgtccccaaagcaaaccttgctttccaggaaatgaaggcttcaggatagttctgtcagaatacatcaatatgatctctccagagtcttttgatgatctttgtgtcttctgtatttgatctagctctgttgattgcagttttgtagctacaaacatacccatgtgttgtactaacatattatataaaattccatttagatatgttttattacatatgcattatctagaattgattatgtgtgttatttactttttatattttatattaataagatatataagtataacttattataagttatggagttttataatacacttctgcacacaaaccataaaacttgggtagggatagctctaaggtttctaattaagctgttaaaaatcatatattataaatattattgaatgacatactgtcctttaaatgcttttttgatgtgtccgttcagtggaaccgaaggcctcatagacactaagcatactgctttgtcactgagctctgaaccccatatacacttcgtaaataaaatgcaggaggatttataaaatctgtctgcacatcagccatgaaagagttcaaacctgtggcagaattctgagtttaaaattattatcttttaatcagataactaatgcaatagctgtaaataatttattggaatgaaaatcattttaatttttccaacttgaggctgatagtttaccattggtcttgctgtcctcttgggcacttcttatggcgatcccttttctttttcttcaggccgttgtacttcagtgagactggctgttgaactttgctgtagttgatgagcagaatttctgggctcttcatcatcccagccccatcctagttgaaaaagattcaaatgccctaactttgcactttgcttttgaagaaggacatttctaggatggagagaactgtgttatagtttggttccaggacactggcatccaatgcccactgactccagtgtgagcgcggaaggttccagagagagggatcagtccgcgagttcacaaccaggaacccagaaacaacctggctttaaaaagcacagcattggagacactccatgagtctgcttggcttccgggcaaagtagcatttaagaccttgtgttaaaatggacaccggggacacagctctaggacaaaaagctacctcaaggtctggagaaactgacagcgtgtctggtagatggaggcaggaacaatcagctgttcttaagatgagcactttcagcagtcaggaagggccaagacaaccacagatagatcctgagcagatcggaaatgcagcttcggcgcagctggttttggttctgggaaagctggcctcgcctggcgagggcctacatcaagtcacagagaagcaatacccaccttcaccgtccgagtccctacccatgccaacactcgctctctttccctcagcattcactatcccagggcatgacgcacagccacaagccacaccagagcctagagggccctccctggcttttccctggccctttgccatctgtcgcctctgaggacctatttccttttccaatgcacggccacagcggtggttatcctagaaaaaagatctcaaatctcaaccctgcttacagccaatactcccagaaaagtatcgaacaggcagaagatgctcacaagaaagagcacaaacccaaaaagccaggcaagtatatctgcccgtactgcagcagggcatgtgcgaaacccagcgtcttaaagaaacacatcaggtcccatactggtgagcggccgtatccatgtataccttgtggcttctctttcaagacaaagagtaatttgtacaagcacaggaagtctcatgcccatgcaattaaggcaggcttggtacccttcactgagtcatctgtatccaaattggacctcgaggctggttttatcgatgtagaagcagagatccactcagacggtgagcagagcacagacacggatgaggagagctctttatttgctgaggcttctgacaaagtgagccctggccctcccgtccctttggacattgctagcagaggtggctaccatgggtccttggaagaatctttgggaggtcccatgaaagtgccaattttgattattcccaaaagtgggatcccactagccagtgagggctctcagtatctgagctctgaaatgctccccaatccgtctctgaatgctaaggcggatgactctcacacggtgaaacagaaacttgcgctgagactgtcagagaagaaaggacaagactctgagccatcccttaacctcctgagcccgcacagcaaggggagtacggactctggttacttttctcgctcagaaagtgcggagcagcagatcagcccacccaacacaaacgccaagtcttatgaagaaatcatttttggaaaatactgtcgacttagtccaaggaatacacttagtgttactcccaccggtcaggagcgcaccgccatggggcgcaggggcatcatggaaccattacctcatttaaacacccggttggaggtcaagatgtttgaagatcctatctctcaactgaatcccagcaaaggagaaatggaccccggtcaaatcaacatgttgaagaccacgaaattcaacagtgagtgtcggcaaccacaagccatcccgtcctctgttaggaatgaaggaaaaccttacccaggcaacttcctaggcagcaatccaatgctcttagaagctcctgtggactcttcaccccttattagaagcaactcgatgccaacgtcttcagcaacaaatttaagtgtccctccttctttgagaggaagccactcgtttgatgaaaggatgacagggtctgatgatgtgttctatcccggcactgtgggcatacctccccagcgcatgctcagacggcaagcagccttcgagctgccgtcggtccaggagggccacatggagtctgagcaccctgcacgggtatccaagggccttgccagtccatccctgaaggaaaagaaattacttcctggagacaggcccggctatgactacgatgtctgccgtaaaccatacaagaaatgggaagactctgaaacactgaaacagagctacctgggttccttcaagcaaggaggggaatattttatggacccctcggtgccagtgcagggagtgccaaccatgttcgggactacctgtgagaacagaaaacgcaggaaagagaagagcgtgggagatgaagaggatgttcccatgatctgtggtggcatgggaaatgctcccgtgggcatgatgtcctcagagtacgaccccaagctgcaggacggaggaaggagtggctttgccatgactgcacacgagagccttgctcatggtcactccgaccgtctagacccagctcgaccccagctgccgtctagaagtccatctcttgggtctgaggatttgcccttggctgctgatcctgacaagatgacagacctgggcaagaagcctccaggaaatgtgatttcagtgatccagcacacaaactcgctgagccggcccaattcctttgaaagatctgagtcaacagaaatggtggcctgcccacaggacaagaccccttcacctgctgagacatgtgacagtgaggttttggaagcccttgtaagcccagagtgggctcctccaggggatggtggagaaagcggaagcaagccaaccccttcacagcaggtaccacagcactcctaccatgcacagccaaggcttgttcgccagcacaatatccaggttcctgaaatcagagtcacagaggaacctgacaagccggagaaggagaaggaagctcctaccaaggagcctgagaagccagtggaggaattccagtggcctcagagaagcgaaactctttcccaactccctgctgagaagttgcctcccaaaaagaaacgcttgaggcttgcagatttggaacactcctcaggggaatccagctttgagtccacaggcaccggcctctctaggagtcccagccaagaaagcaacttatcccacagttccagtttctccatgtcctttgatagagaagaaacggttaagctcactgcacctcctaagcaggatgagagcgggaagcattctgagtttctgactgtccctgcgggttcatactcattgtctgttccgggtcatcaccaccagaaagaaatgcggcgttgctcctccgagcagatgccctgtcctcacccgacggaagtcccagaaatacggagtaaatcgtttgattatgggaacctgtcccacgctccagtggctggaacatccccatcaacactatcaccgtcccgggagaggaagaaatgctttttggtgcgtcaggcttccttcagtggctccccagaaattgcccaaggtgaagccggcgtggaccccagcgtcaagcaggagcacatggagcacttgcacgctggcctcagggctgcgtggtcctctgtgcttccacctctgccaggggatgacccaggaaagcaggtcggtacttgtggcccactgagctcagggccaccactccaccttacccagcagcagatcatgcacatggacagtcaggaatctctgagaaatccgttgattcaaccaacatcctacatgacgagcaagcacttacccgaacagccacatctgtttccacatcaagatgcggtcccattttctcctatccagaatgccttgtttcagtttcagtacccgactgtgtgtatggttcatctgccagctcagcagcctccctggtggcagacacatttcccccatcccttcgctccacaccctcagaacagctacagtaagcctcccttccaagctgaccttcattctagctaccccttagagcatgtagcagaacacactggaaagaaatctgctgactatccccatgcgaaagagcagacttacccgtgttattccggaacatcagggctacactccaagaacctccctctgaagtttccatcagacccgggcagtaagtccactgaaacgcccacggagcagctccttcgagaagatttcgcctcagaaaatgctgggcctttgcagtccctaccgggaacagtggttcctgttcggatccagacccacgttccatcctacggaagtgtcatgtacacaagcatttctcagatacttggacagaacagccccgccatcgtcatatgcaaggtcgatgagaatatgacccaaagaacactggtaaccaatgcagccatgcaagggataggattaaacatagctcaagtgcttgggcagcacacgggcttggaaaaataccctctttggaaagtacctcagaccttacccctgggcttagagtcctctatccccttgtgtttaccgtccacctcagacaacgcagcctctctcggaggaagcaagcggatgctctctccagccagcagtttggagctcttcatggaaaccaagcaacagaaacgggtgaaagaggagaagatgtacgggcagattgtggaagaactcagtgccgtggagctaaccaactcagacatcaagaagggcctttcccggccccagaagccccagctcgtgaggcaggggtgtgcttcggagccaaaggatggctgctcccagtcaaggtcttcttccttctcctccctgtcaccctcctcttctcaagaccatccgtctgccagcgggcccttccctcccaacagggagattcttccagggtccagggctccgccgcgacggaagttcagcgggccctcagaaagcagagagtcctccgatgagctggacatggatgagacgtcgtcagacatgagcatgagccctcagagctctgcactgcccaccggaggcagtcagcaggaagaggaagggaaggcccgcaagctgcctgtcagcatgctggtccacatggcctctggtcctggaggaaatgtggcaaattccactcttcttttcacagacgtggccgatttccagcagatccttcagttccccagtctgcggacaactactactgtgagttggtgcttcttaaattatacaaaacccagttttgtgcaacaggccaccttcaaatcctccgtttatgcttcatggtgcattagttcctgtaacccaaacccatcaggattgaacaccaagaccacgctggcccttctgagatccaaacaaaaaattactgcagaaatttatactctggctgctatgcacaggcccggagctggcaagctcacttcatccagcgcctggaagcagtttgcacaggtaacaacagaccctggcttagaaagtacggtgggttgtgggtcagatgctaagtagactgtgaaggatagaatatctaaaaggtaaaatatagtaggaacattttcgtaacctgctcttatccagagatgggagatgccatagcctgcctgagggctcccagaaaagctccaaatattgggagtgctttgtcagcccagataaggggaattctcctgctgggagtaatgattattggtcattttcccctctgcctccttgagtgatagtgcaaacatgaggaaatccagggcttatgaaatgaggaaatgaaacatgggaatggatactgaaaaaaaagaatgaggaggaagtatggagggtgttagacctcagagggcaagtgccaccaatgacaccaagggtgtgcttgactacaattcatattctgtgtatctctttcaaaaatgactttccccagttattgttttctcctgatttgcccctatatagttagtccttacatgtaaaaatttaaaatatgataacttttagagtaaacaaaattaatagtgaagaaaatagagatttgaaaaatgtattttggatgttatgttaaggttagtttcccttcaatgatttttgaaactacctccttaatatggaatgtttggcttgttccttcaaatggcagagtatgtgttagtctctgttaacatttcacagaggaaatgagaagtactcagtggctgtgcacctaaacattgaagtgaccatatggaaactgacatttttccctctgattttatctctggtgtcctctgttttctgcaatcaatttgtagccttttattaaagaatttaagctagcttgcaggaatgatagaagggcaggatgtataggccagactatcctggagaaagcacgtggaatgattctctcttttgatcctgcagatgaagcctgatgcgcccttcttgtttggcaacaaactagaaaggaaattagcaggaaatgtcctaaaggaaagagggaaaggagagattcacggagataaagatcttggatccaaacaaactgagccaatacgaattaagatctttgaaggggggtaaggaaacataagcccagatgtaaaatgttcagttgtaagttggtgtgaacgatcctgatggttgtgtgtggtaaatagtgtgtgatcttgcagatgcacaaaggaaattcttttctcagtcaaagtgatgaacgctggctggagaaagctaccaactacatacattttcttctaggacctgccctcctcagtgagcacggtcccattgtgcatcataagttccctctaaatttatatgaaattttctacattggcagccccatggtgtctcatatgttcctttattctttactacttcctcagcatttgggttactgcatggacatacttgtattctgtgttgatatgagtggaaccatgcagacttctgtacatttctaagaaatagattctgtgaacttcagtctttcatgggatccagacactttcatgacttttttttttttttttttcctctccaagtcaaggtatgggactcaagtagtaagggccaatagttataaacatggtacataaacatatgatacacatatttgatatgtacacatatcaaataatatacgcatataacatatatagcaaatatatacaattaagaaaatataagtatatatgatagctacgtttgttttttttccaaaaaatttttattagattttttttctttttttttcttcatttacatttcaaatgctatcccaaaagtcccctataccctccccctgccctgctccccctaggtttttgtttcaatagaaatatattagttgcaatcaatggaagaggtctagagctatgattttagctaaaaaaatgttaactacattaaatatatttgggggattatgtcatttagtcccatctcaccaacctgtctctaaattacaaagtttcatgaccatacttttattccaatggcatttgaaggacaaaattttacttttgaccatgaaaaaaggttgactgttagtgacatagaatttctcacacttctacctaccaatttggagttggttgttatagttgaggtgcccttggatttttttgcttcatttaggcattgagtcttttcaccacacttgcatgtatgcatgaactttgtctcaggattttttgacatctgacatatcattacataaatgaaaagaatatagattttgtctttcccaagagaccggtctctcagatctctgtgactcagtcatcatacttcaatgcagcagctgtcttcagagtagtgcatatgtacttacatacatgcactggtgtatatggcttacagcaaccatcaggattattgtatgttttgaggaatgcatctctgctaacaaagaacataggtggaaataaaaacacttctgggactctcttctgctgtgttttgatgatccagaaaaatcacatgtattttttattttctgttttctaactcaggcacattttaatctctgaactaattctctaacaatttctggtagccagcattcattccaaacagcacattctcacctctgacgttgttggttgcaagtggtaacaacagtgacagggattactgactagattgtccaggttatctagttgatagggataatatgcatttctttaaattgctgcttttcaaaatccattgtgtactgggttgatttgtgggtcttcagaaatgtgggtattcataaataggctagctgaacacattatccccatatacagatttatgtagaattttactttatttcattctttagatgagttaatcacctaagacactgaaaatacttttttgtttgaggagaaaatgtgcttctcatcaactaagtgtctcagcgtttcttctgctttgagggaaaacatggtgaccaaaaagccatttggggaggaacgcattcattatacctccagatcatagtccatcattggagtaagtcgggcccggaactcaggcaggcctggaacctggagacagtagctgaggcagaggccatggaggggtgctccttactgtcttactcctcatggcttgttctgcttaccttcttacaaaacccaggaccaacatcccagggatggcaccacccacaataggctgggctttctttcccacaattcataagtaattgagaaatacattgtagctggatctcatggaggcatttcctccactgagagtccttcttcgctcacaactctagctcatgttaagttgacagacacaaccagccagaacaactgacctcatgtcaacttgacacacagtcactattaagccaccacccttcctttcttattcatccccaagatctcacatttaaaaacataagtttaaaagtcctacagtctttacaaacaagctcaaacacattaaaattacagtccctttaaaacagccaatgtccttttaaaatttaaagtcttttaaaattcaaagtctctcaactgtgggctacagtaaaatactttcttacttcaagagggaaaatcagggcacaggcataataaaatcaagacaaacccaaattccaatcagccagtgtctgggatccactcacaatcttctaggttgctccaaagggcttgggtcccttgctgcaactggcctgcactgtagacgttatgtcctggttcttcctctcaggcccatgttcccagaaataagacacagactcaaaatatatttacaaatactgtggacatatagctaggctcctctctgactagaattataacttaagatagcccatttatttgaacctacattctgcggtgtggctggttaccttcgatcaggcatgatgagttcttctcctcatgtcttcctgggccaatcttactgtgtctggctctgtctcagaattctctttccttctagatgttccacctcctaattcctgcctaagccatagcccatcagttctattgagtggtgccacatgcatacagacataagatattctttctatactacactttcaccagtggcttctcctggcttctcacatggccttggtggttctccatgaccctttcatggcttcaaaaccagtactaccttggtaactcgtactcattaccaagtttggctgccagcactaggtacaaccttggccacttctggagcacttgtgctctcaggaaacactacccagaagatttcatctcagtgatgctggtctctccttaatcactgctaatttcttagctcaagctgaccagcatcaagtatccaaacaaagcaaagttttgatttagtaattctagtatcttttaatcacagctgctttttcatccccagctaccagaactacagaaccttaattcgagatagcaaatggttctaatagagtcttcaaaccccctctgaaatttcctaagccaggtctccatcctttgccttgcatctcctaagctcctatagaacatcccacagaactcttaacatctagtgacccttctaaccaaaaattccaaagtccttccacaattgtccccacaacatggtcaggtatgtcacagcaatattccactatgcttgaaccaactggtctttgttaggatttatattgctgcaacatgactggaaaaaaaaagttgtggaggaaattgaaattggttattcatcttacacttcaacattgctgttcattaccaaaggaagtcaggaaagcaactcaaacagaactggaacccagagactgaagccaatgaagaggccatggagggatgctgcttactggcttgttcctcatggcttgttcaacctgctttcttatagaactcagaaccttctgcccagggatgaccccacccacgatgggctgggctctctctcccatctaccagttattaagaaaatgccttatagctaaaccttatggagatattttctcagttgcaattccctactttgacataactctggcttgtatcaagttaatgcccaaaaccagccagtacaactcagtattgataaagctagagtaacctttcctgaagaatattggctttctgtaaaatcatcatatccccttaagcaatttcatccttcttaggaacagagagtgaaattgaatgtagaaggatgattttgcgtcttgaggatgtgttctgatttattataaaatgcaaacatgagaagaaaacaagttttaaggccaagccatagttggggtgttttatgaaaggggaaatggcatgtaaaattgatggttctcatcttcccctttgattagtaccgaccaaaatgcccaacatgctgagatgaagctttatccgtagcagagttgatattccaacacatggagagatgtttcatcttgaaaagccttctacaaattggacaattgaatttgaattcgcttttgtgtctgcttgggggcattagctagagatgggcatagtcagaagcctcttagaatgggaaaaaaacataaaacaaaacaaagctctaggtctaaataccactaggaattccacagtgaacaaagatttttgcatgttagccaacctatggaagctatacaaagaaccttcagaaatcctttcttgccacaatgacataggaactatgtcatatgccctgcagtgatgtaagggattgtactatttattcagttgtgcagtataggtctactgtgtgataatcaaaatctatgtgatttatcatgtgctgtcggtttctaagcaaaatgagattacagagcaatgggttggtatctcctcttctatcaagactttcttcatctccagctcatgacagtagatggcctcaggtacactttcagaccaatctttcaggaaacaaacactaatttcatcccagaatctctagttctcattatgcaacgctgctttcaagaagccagttgaaatttaaacttcacatgagtacagtttcatggtcctgggaagaacagatcacatctgtagacaacagttggggagcagagcttagccttggctaagttgaaatttcagaggcacacatgtaccagggttgtaaaaatagagtagaaacttgcaagggagatttctattctcagttaggattatttctgaaaatgtctccatacgtatattatagatgatgtcatgttaacagattatgcacgaagcatggttattctaaaatgttggtatgcatttagtgatgctctttgactggatgctatactatgcccacaagtgggaggtccaggtctgtatctctccggacttaggttaacctattgggacatttgtgtattccatcagtaaatctgttattccacatagaataaagttttgcatacagcaataattctgttacataaattgtctcaagtgtttgctatataaacttcccagagttcgtagaagtcagggtgaataattggaaaagaccctcatagaaattgacatcaggcaatgactagcttttggtttggtatatcacatgctaagagtatttaaaatcacagtggtctgcctcttcttcaaataggtacaaatccaatgaagattatgtgtatgtcagaggacgtggacggggaaagtatatttgtgaagagtgtggaattcgctgtaagaagccaagtatgctcaaaaaacacatacgcactcatactgatgttcggccttatgtatgcaagttatgtaattttgccttcaaaacgaaaggtatgagcttggcttttgcagctgctgctgctgtttggagagggaaaggtttcagggaaacttcctgctacttaggattctgagtattattttgtaactcactttcaccaaccataaagagtattttgtttgtgcaaatataacccccctgagatatatttcctccttcctgtccaggatcaaaggatgtatgtgagactctgagactccttttatgactaattaagagctacagactgagggccaggcaggttgtctctgaaggaagtggcttagaagtgcctggatggctattacttcatgttggaaatttatgtgggctagataatatttgcaacaatattgagattcttcaggaaggcaatatgtgagagtcagtggataagcaagggaagctactgagaagaaaatatgtggccatggtcactttcaagcgtataaataatgtagagatccacagactccctggtgggccccctccatccacagctgcattaattatacatagagacttgatagcttctgttctgtgtatttatcagcattggaggcaagtcttactctcagacctcaagagttaatctcatccagcaaagacctgccttgagataacctgttgttttccaatatccgttttaagaggctgatttacacagaaatgtttcacttacggttgctcgacttttatttctattattctgtaatccggtgaaaatcttcatgttgcatgtcagatctgtctaaggtagcttgtagacagcccctcatcaacccacttcatttctagcattttcacatttaatgttaatatcaagtaatctgccctgacacatgagaacagacaattaaagccaggtatgaattgtgataatccggtagggagacatatacctatctcagttgtagcccacaatattaagctgtgctcttttgacagaagtatagatattcagggtcttcaaatatctgtttattaggagagtatttatgtgtctttaatgcctcatttgaagtttgatagagagaggaaacataaacatctgtatatctaaagaaataaggatattgctctttaaatacccttctcccttagcatgatccactcccttagcatgatccagcttactgagaagttcctgggaggaaagatgtgaaagtttgattttagggcacactgcaagtccaccaatcactgtaaagtttacaaaataatactctaagtaaatgattaaatccaattatacaccattgggaagactccaccaggaaagagtgtcctcttgatcattagtggaatttccttatcagcctttgggagtatgcaggcagaggtctaggaatttgagggttagcagtgcattcttgggagctccacagggttcatctgatgaaatatccacttttcagatttttgttctctgagtacaagtgtgtcataaggacctatcttccccttgcctgtaccaagctcctaaggaccaatccctctcccttgccttaccaagctcctaccattgtctcctatcctgctctggtctgctacatcagatgctcatggcttctgcaaaccaaagtcaaggtgggattgtttccaattccaacttcctagctagaaatctgctctgaagattacaaacctactcagaagaagagagcccaaataagttcctctctggagtatgagtatatatagttcatagttactgtatatgaagaagcacacgaaagttcagacagacttcgatctgtgcctgtgagggattgattttaggagctcccatgcaggctcagcccctggataaagtggagtattactggcacacagctcacatcctcctctatacttttaaataatttctggattacttgaataccttattcaaagtaattgctgtgtttttttttaatcgtattgtttatgcagtacccaagaaagtagatgggagtttttcaatacagacaatcttttcttccagttttgatccttgggtggttaagaccacagaggtagaagtcatggatacagagggctggctgtatcttatcttgccatgcttagcatcttcacccatatacaacaccatgcatatacaaacagtagcagaaacagatgagtttcatgaattcatggaaatttaataaagtttaactcacttacatccttaagagttaacatatccaaaatctcttcaagctctttcaaaaattatagatgttttgaatagagcaataaaagtgtagaaatatttgtattggaggtataaaaataatatgtagaattactagatctataagcaacaagttaatcataatgtgagatagtaattttttgaaaggatagttcattgtgatttaattaattaattaattaataagcatagctgtatcagagagaggaaaataatgccttcatcaggctgagtttctacccaggtttctgggagcctgtactggaaaataaaagtgcatacttgtgtgttaatactatattgtcaagatgacaacagacaataacatagtcatttcatgagaacaaatgaatatactctaagaccctgcattgatccctgagtctcttatgataagttttgtagtatagaaaaatgcatgtgcataaggtagttcatcacacaatgttttgtatcagtcatcacagtttgataattaattctccggttctcttgtttgcattttctaggaaacctaacaaaacacatgaaatctaaggcccacatgaaaaagtgtctggagctgggcgtgtcgatgacatcagtagatgacacagaaacagaagaagcaggtacgtggcttactgaatggactggcctctcgggtggcctttgtggtcctgtgattacacgccactttattaagtactctttgcagggaatgaaacagcatactgagctgcttgggagctaaggagaaaggaaaccatttgccgtggaacttgttttagagggggagggctgtattagcaaaataattgtctctaaacacgatacagggatgtgtgcatgaggcaggggatggagttgtgatttatgtgctgtgaagctttgggaggaaactgaaagcattttaatgtgttagtcttcctattgtgactatccatcattaaccccagtcgaggatctggaggtcggcaaacctcctgaggtatccctcttacacataaacttgcacctgaaacaggagagacaggctgtcgctttgcttttcttcctctagtgtcagtcattagcaatactagccacatccatttgttttgagttgtgtcatgagacttctctgaagtctgaaataagagatcctattctggagttctcaggggtgaaaccaagtaggtacaagtaagtgtccaggggtgattcagagccatgatcaaacgtttcagggggtgaaggggggtaaggaaagctttggggaagagtgttggggcagatagaagctcccaggcttgaaagtgggatcttaacctctgttaataattactgttgggttctttcagaaaatatggaagagttgcacaaaacatctgagaagcacagcatgtccggcatctccactgatcaccagttctccgatgcagaggaatcggatggggaagatggagatgacaacgatgatgatgatgaagatgacgatgactttgatgaccaaggagatttgacacccaaaacaaggtcaagaagcaccagtcctcagcctcctaggttctcctccttgcctgtcaatgttggcgctgtagcccatggcgtcccttcagatagctctctgggacattcgtcattgatcagctatttggtcactctaccgagtattcaggttactcagctcatgacacccagtgactcttgtgatgacactcagatgacagaatatcagaggctgttccagagcaaaagcacagactctgaaccggacaaagacaggttagacatcccaagctccatggacgaagaggccatgttgtcttcagagccaagctcctccccaagggacttctccccctcaagctaccgttcctccccaggctatgattcttcaccctgtcgagataattcgccaaagaggtatctgatacccaaaggagatttgtcacccagaagacatttatcacctagacgagacctgtcgccgatgaggcatctgtcaccaagaaaagaagctgcattgaggagagagatgtcccaaggggatgcctcaccaagaaggcacttgtccccaaggagaccattgtctcctggaaaggacattacagcaagaagagacctctctcccagaagagagagaagatatctgaccaccatcagagcaccgtctcccagaagggctttatatcctaaccctccattatccatgggacagtatctacaaacagagccaattgtattggggcctcctgtaagtatagcctgagttctcttcaccagagctgcagagcattagaacctcctataggatagttataaggcatttattataatgtgggtgtaatgaacctattaatacaaatagcagggagacattttatcacacatcgtgttggtgacatggctgtggcattattccaagtataagattgtatcaaagcaggagtgaacttgcaggtaggaacaggagaagccttccgaatgttttgcaagcataactatagacttgagccaaaacccttaggtgacgccccaggtatggcatgcttatgaaggcaaacatgaagacagtaaattgttagtgatatttacacttcagcaggggaggactctaatgcaggcttcgtccttgacttccaaaatgatttttaaaatatactcattacattgcccaacatgtgtacatgtgcaaatggtcagggcctgggaaaaggtggtgtgacactctagtagcccataaggtaaagacataaaggtttctgcactttttttttcctgttgttgctgttagcaccaggtgtagatgctgagggagaattcgggccagagaatgagctgtcagagggctccagagaatattctgaggggtccacctttttcttgtattattaagtaagatgacagcagtagtggctatgggccacactgaaaccacagctttactgaaaagctacaacggagcccctcctctcctcattgcacagcagcctggcagatcatggtgtctctttccattggggtaggattgtcaaagagcaggcagagagcacagaggcatgctgccttctgagtttgtttgctttaaaagtggtgctagtttccagatcttccttcctgccctctttcctctgttttctgtctggcatagcatggtctttctcaggcatagaaggcactgctaactcctcgctctgtctgctcctgccctggtagccagtcccttctctctcattgcctactgctatcttgattcatgagcttacactgccattctcaaactgtaggaaatctcccagccttccttgcagtatcctcatcatccttttttcataaaccgggaacaaagttcatcttgatgttgcaatcctgcagagatgtgccctgatgtctgcacccggctgatttcaagctagtaaactagcaagctaggaaaaaaccaccacatctctgcaagtttctatatcttgtgctacctaagtcactatatagttactaggaagctggaaatccctctgatgattcctgtgacagacacatggtgatgctgacagggtgcgctaaactagtcctgatccctccttcctgaggcttttgagtcagcttttggccaagcagaccataactggcttctatgagtcaatgggacacattcaggtaaccatgtaatgaaaacaaagccattgatttaacatgctgttaaactcaggccaaggaattcattaactaattaagaataaaataaaacagaataaaataattcatttattttggacctttgaatccctacaaagttaattaagaaatttagtgccaaacaagaaaataagtttcaccagttactgagtttttcctaaatttttgtgtggttttatttcatttcattttgttcctaaaatctctggatgcctcacagagctcatccttcatccccaacaaatcctttggcttgctacccagtccagttatctttaaagaaaaaatgcccccttgctgcttgttctcataggaggcagcagagctgggattcaagcaggagccctgtcctgagtcctcatgttgtgttgactggtcgcctctggatggcagtgacaactatatctttctgtgatgtgtgaaagagacatttctggtcagagaaaaatagacctgaccatgctctgacaggtgtcccttctgactgctctgtaggatgaagactttcctctctctaaaaaatgtatagaaaggattatgaccagccattgtcccttgtcacagaaattctgtcctgctaccttgtcattttgcacaccttgatggaagctttacagggcaatgactggggtgaagggaccgtgacacccaggatgacataagatataattggtttagtctgaacttagagccagagagaaggtttagatggagaaacacacaccactaggattcctcctctaacactatctggttcattttaatagatagtagaatttaaaagtgtctttattcagtcagtcaccatttttgaggactggaactggagtatggttcaaaagggaaatatattacagttacagcctcattttcttatgcatatctgtttctgtgtgtagatgaagagtgtcttcagtaaagcagtcagtgctcagtctctctcttgtctgtgccatcttgggtgggttgtcttgcatcgtggccacttgtgtaaggaagtctgcatcagtcagacatagtccttgcctagatattgtctgtccctaaaagatgttgcacggctataagcagtacagctgttagcacttttaggttagggcctttctcaggtcaggacttctgctcagttacctctagctggtgccaaaagcattagggttcctctgccttaactgctgtttgatgaagacttacacaccatttacaggattcttcttgagtcctgaaatggtcacgtatcctaccttttgaggttctggtaattccagggatgcttattggaccatttcatctgtgttgcagaacaaataatttttgtacagcttgaataagctgtagcccagaccaagatgaattccaagcatggtagacagtagtaggcatatgcataatgtatagtttggaggccaggctcaaatctaaatagaactgtatggatccctaatggtagcatttggtccttgaatctgagcactgaagcatccttgagatgaatgctacaatttttaagatagctttccaaaattgtgagcatatttgacaagttttaatctaccttgagttcccatataaggaagcagtgaagtccattattaatgaatcctagcaattaaaattctgactaattcactagagccggataatctggcgatctaagctgtgttctactacaaaaaaatgagaatagcaaagtcttcatttaaggagaaaaccatgaaatccagaattatggctccaaattttaaatacctttgcttcattaattccaagaagacattcatgttataagtaataccaacaaaaaaattgagccataatcatctttgatttcagctatgaaattgaatataaatgattaaccattaaacacacatgctattaatgggtatttgcttcctttcaaacattgccatttctacaagacttagctttgatctgggacttgaagaattctgcattctttacagggcctcttcttagttgggatgtattcttgtaggcatactaagatctctcctcatagtggtttcttcctctagattagtgctcaacacaaagagacttctaagtagggatgtattcctgtaggccaagccttgcacagcaaaggaacagatttctcaaaaccaccctgccttcctttgtgtgaaaaagtgttttctctagtgggaaatatttaaaaagcaatccttgcaacactggcagggcattggtggacaggctggcctgttttcagcctggtctgctttcagccttgtgtactctttgactggaagctctgaaatctctccaccaggcttggcaaagttcccagggcaggtcattgccacaccagccccatgcttccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattttgccctgcattctcaccccagtccaccagcccagtctcctcttccatcatccctttctccctttctctgacccggaagtcccagtgattggttccttgaaatcttgattcattaggggaaggttcacatgaagtcacatgagtacatgatttcactcccttgtcccaggcatcccctcttggggaagtggaattagcaacaaaatagaaacagtaccagtgctatccataatggttttctttctttctttttctttttctttttttcatttttttttctttttttgggttttttgagacagggtttctctgtatagctctggctgtcctggaactcatgctgtagaccaggctggccgcgaactcaaaatcagcctgcctctgcctcccgagtgctgggattaaaggcatgcgccaccacacccagttcacaatggttttcttaaagcctgttgccaacttattatttttaccaagcctagggaatatctttcagtgcagcctacagcataaatagttgataatcttgttccctttgagtttaaatcccatcaatatttactagtcatcctttgtgtgttttgttttgtgttttctttgttggtttgatgttttcctggtgaatccattctttttacttgctcttctgaagaaatacccatcatgtgatattatgcctagtgggaaatagactggttgctttagcattttgcacttgaaaaacaaaagccactgtccacaggggaataccttcattaaagaactggaaaaattagttaaggaagctattcaattttgagaaattctttctaagtgccaggcatcctgaagaagggatgggaaaagagagggaaagagggaacaggtctcaactctgtgctctgttttcctgtgtagaatctaagaagaggaatacctcaggttccttacttcagtctctatggagaccaagaaggtgcttatgaacatcacggctccagccttttccctgagggtcctactgactatgtcttcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagcctaaattcccggagagagaaggggaggaaaacatacagacttgtacaaaagccattgcctcactccggattgcaacagaagaggcagctctgcttggggctgaccctcccacatgggtacaagagtccccccagaaacccttggaaagtgcacacgtcagcattagacactttggcgggcctgagccaggtcagccctgtacctcagccgcccaccctgacttacatgatggtgaaaaggacacttttggtacatcacagactgcagtagctcaccccacgttttacagcaagagcagtgtggatgagaagcgggtggactttcagagcagcaaggaattatctttaagcacagaggaaggcaatgaaccttcaccagaaaagaatcaactccattgatctgcaatgcatggacacattcatttccacatttccccctcccctgttttgtttttgtttttctaggaatagaagtaaacaagttgatagcatgcctgtcctaagttacagtagttggctattataaatacttttgttattttgaaaacaattaggtaaattaacaagtcatcttgagcctgaccaaaacaaaatttgaaattaacctattgggtctggtactttgaaaattgtacagatgtttgtgccttttctttactttgcttatattcttataagcattttttagcagtaatttgtacatattttagaatttgtgtatctgctttgtaataaatgtaatctctttcctcttttggacacttggatctaaacgatgtaaagcaaagcagcatctatatatatgtgaggttgcactaaaacatatttttatatgataaaaactgaacagcttttatgtacagctctgattctgtaatactaatatttattttgtttcataaactgtacatttttcttaatgttgtggattgcttttctatgtgacgcatggatttaactgttgcgaaactagaacggaaatgtccattgtaagcaagatatttaaactagaatatcttattctgcacttatgcattagttacaaaaaaaagataaagaacgtatcagtcggttcttaacttgtaaattctttttgtctcttgtttgctggattgacaataacttaagtgctggttgtgattttaaatggatagtaccgtaaagcattaaagtaaacaatgtgctattgtgagttttttcaaagctttataaatcagttataaataatattaaaagtatttggtcttatgtgaacatgttgatctatatactcatctaaaaatatgggaaaaacattccgccccatgtaaatatgtacaagtgcatcactggtacaattttctgttactcggttggacacgaggttgccacagacctatgctagagtgtctttaaaattaaagtgagaaagcacatggactgtgtagagcttggttatcggccggcccggtggcttggtaggcagtgctgtgcactgcccatggagaagacctgggcttaaaaaaatcttggttcttgctgcacaggatagtgactggaactatggctgcagggagggttcgcacttggactcgagggttgggtgtggaagtggggaaaggggatggagacctgctccccagctcttcccatcagccagtccacatggttacagggttaccatcagcattaggaaatgtcaccttacccttatgtacagggaaagagtgtcactcctggctgtctcagggggaatgaagaagagaagccttcaagagaaaagcagctcttggtaggaggaagttttttttgtatataaccttcagaatggcttttgatcagtgttgaaggtgggaagagcctttgcaggtccagaagagtggagcagagggttacagcaacatgtgcacacgcatgcacatgtttgtgcatgcgcacacacaatctgggttatctttgtgctatatagtggattataattctgtgaaaccaagtttgtatattgaattacattaaggagtgttctttaaaaagagaaataaatatacaattaaatgcttgaagtgtctagttcttgtgtgtgtgtgtgtgtgtgtgtgaatgttttgtttcacttctgattttgtttcttagaggcttttgatgcttttaacctacactctaattttaattgttaggttccatctatctcaagaggcacatcaactgcagatggtctctaaccaagtgataaggtagttattggtttccatgggtcatctgattagcctagatggcagggagtttctagaatggaggcttgcgaaatgaaaagacttgagcctaggaagcatgcactcttgtttccaaggtaaaaaaacaaaaacatcagaaatatacaaaaaaatatccacagatcaaggggctcttgaagaccagaatctttttaattatgaaagtaattaaaaagttcataacgtagaaatctcagtatttttattataaatacctcaagttggtaagtgtgtaccttacctgttttgtttatgagtcagacaatcataactgttgtgcaagcgtgaatccaaggtgaacaaagatgaccaactaagaatctccagatcgttttcattatgtagggagagttttgtcttactcctctgacatggggtgtgagcgatggagaaaaggttggggtagagaggatttagggcctttgcttttgtccagttcttcagtgttcatcaagcagtgcttgggtgcctgttatgagctgagaagaagatggacttctgcagtgggtgacaatgtttgttttccagaagctcacataagtagtggagatttctatgtgagcaaatgttagaattaaaaactgcactggggcattttgtcataatcaaggttggtaatcaggactgtgcttttgtaagtaggaagagggagacccccccccccccccggccagggccttgggacacagcctagaaataatttgttgacagactcaacatacattctcatgagctgcaatggagtgccattcagtgtactgggtgtacattgcaaagcagatcaaattcttgactgtctgtcacctatgttcaatggggaagggatgttggagggaaggtgaatgacgtgagaaagcacaggtgtgatggcccaggatacatgaagctgtacatgcacaaagtgagcagagtggagctgtttctgaggggagctggtggagtggtacatggctagggcagagaccagaatagagtcttgtttcctagtccattgtgtgagtctgcaaatccaaggaagaaagacaggagcaagaaagtagcttttgcagggtgtgtgtgtgtgtttgatacatactacatacatgtatatgtaaaatttagaaagaggtcctgagggatgggaagaacagaaataatggttaatgtaacagggtgcccatgtataaagtgatcaaatactgtacattcaattttaaaaagctgggagtgatagttggtaatcttagggctggcgatgtggagaagggggaaatcctagggctgactagccagccaaactagtttgtttgttgaaatatcaactgtagatggtccagcctttcgtctcagctccaaactttgtctctgtaactccttccatgggtgttttgttcccaattctaaggaggggcatagtgtccacacttcagtcttcattcttcttgagtttcatgtgtttagcaaattgtatcttatatcttgggtatcctaggtttggggctaatatccacttatcagtgagtacatattgtgtgagttcctttgtgaatgtgttgcctcactcaggatgatgccctccaggtccatccatttggctaggaatttcataaattcattatttttaatagctgagtagtactccccatctagagactgccatatccagggatccaccccataatcagcttccaaacgctgacaccattgcatacactagcaagattttgttgaaaggacccagatatagctgtctcttgtgagactatgccggggcatagcaaacacagaagtggatgctcacagtcagctattggatggatcacagggctcccaatggaggagctagagaaagtacccaaggagctaaagggatctgcaaccctataggtggaacaacattatgaactaaccagtaccccggagctcttgactctagctgcatatgtatcaaaagatggcctagtcggccatcactggaaagagaggcccgttggacatgcaaactgtatatgccccagtacaggggaacgccagggccaaaaaaaatgggaatgggtgggtagggaagtggggggagggtatgggggacttttgggatagcattggaaatgtaattgaggaaaatatgtaataaaaaatattaaaaaaaagaaaaaaaagaaatatcaactgtataaagggctttcagaaaacaagtcgagcggcactttagtttatctctggcctccacatgcatgtgcaacaactatgtacccacacatatacaaatacatgtatagacacatatgtgtatgtgtgtttgtgcatgtgaacatacacatacaaatgtgtatacatatataatgtgtatacatatataactttaatacttgtacatatatgtatatgtatgtacatgtatttgtatgtgtatacacaaaattttaaggagcaacactagaatgatttaataacagtgcttagttagaagcattattaaactaacaatctttttcg

SEQ ID NO: 2024 - DNA, 6556 bp, Mus musculus
tggctttaaaaagcacagcattggagacactccatgagtctgcttggcttccgggcaaagtagcatttaagaccttgtgttaaaatggacaccggggacacagctctaggacaaaaagctacctcaaggtctggagaaactgacagcgtgtctggtagatggaggcaggaacaatcagctgttcttaagatgagcactttcagcagtcaggaagggccaagacaaccacagatagatcctgagcagatcggaaatgcagcttcggcgcagctggttttggttctgggaaagctggcctcgcctggcgagggcctacatcaagtcacagagaagcaatacccaccttcaccgtccgagtccctacccatgccaacactcgctctctttccctcagcattcactatcccagggcatgacgcacagccacaagccacaccagagcctagagggccctccctggcttttccctggccctttgccatctgtcgcctctgaggacctatttccttttccaatgcacggccacagcggtggttatcctagaaaaaagatctcaaatctcaaccctgcttacagccaatactcccagaaaagtatcgaacaggcagaagatgctcacaagaaagagcacaaacccaaaaagccaggcaagtatatctgcccgtactgcagcagggcatgtgcgaaacccagcgtcttaaagaaacacatcaggtcccatactggtgagcggccgtatccatgtataccttgtggcttctctttcaagacaaagagtaatttgtacaagcacaggaagtctcatgcccatgcaattaaggcaggcttggtacccttcactgagtcatctgtatccaaattggacctcgaggctggttttatcgatgtagaagcagagatccactcagacggtgagcagagcacagacacggatgaggagagctctttatttgctgaggcttctgacaaagtgagccctggccctcccgtccctttggacattgctagcagaggtggctaccatgggtccttggaagaatctttgggaggtcccatgaaagtgccaattttgattattcccaaaagtgggatcccactagccagtgagggctctcagtatctgagctctgaaatgctccccaatccgtctctgaatgctaaggcggatgactctcacacggtgaaacagaaacttgcgctgagactgtcagagaagaaaggacaagactctgagccatcccttaacctcctgagcccgcacagcaaggggagtacggactctggttacttttctcgctcagaaagtgcggagcagcagatcagcccacccaacacaaacgccaagtcttatgaagaaatcatttttggaaaatactgtcgacttagtccaaggaatacacttagtgttactcccaccggtcaggagcgcaccgccatggggcgcaggggcatcatggaaccattacctcatttaaacacccggttggaggtcaagatgtttgaagatcctatctctcaactgaatcccagcaaaggagaaatggaccccggtcaaatcaacatgttgaagaccacgaaattcaacagtgagtgtcggcaaccacaagccatcccgtcctctgttaggaatgaaggaaaaccttacccaggcaacttcctaggcagcaatccaatgctcttagaagctcctgtggactcttcaccccttattagaagcaactcgatgccaacgtcttcagcaacaaatttaagtgtccctccttctttgagaggaagccactcgtttgatgaaaggatgacagggtctgatgatgtgttctatcccggcactgtgggcatacctccccagcgcatgctcagacggcaagcagccttcgagctgccgtcggtccaggagggccacatggagtctgagcaccctgcacgggtatccaagggccttgccagtccatccctgaaggaaaagaaattacttcctggagacaggcccggctatgactacgatgtctgccgtaaaccatacaagaaatgggaagactctgaaacactgaaacagagctacctgggttccttcaagcaaggaggggaatattttatggacccctcggtgccagtgcagggagtgccaaccatgttcgggactacctgtgagaacagaaaacgcaggaaagagaagagcgtgggagatgaagaggatgttcccatgatctgtggtggcatgggaaatgctcccgtgggcatgatgtcctcagagtacgaccccaagctgcaggacggaggaaggagtggctttgccatgactgcacacgagagccttgctcatggtcactccgaccgtctagacccagctcgaccccagctgccgtctagaagtccatctcttgggtctgaggatttgcccttggctgctgatcctgacaagatgacagacctgggcaagaagcctccaggaaatgtgatttcagtgatccagcacacaaactcgctgagccggcccaattcctttgaaagatctgagtcaacagaaatggtggcctgcccacaggacaagaccccttcacctgctgagacatgtgacagtgaggttttggaagcccttgtaagcccagagtgggctcctccaggggatggtggagaaagcggaagcaagccaaccccttcacagcaggtaccacagcactcctaccatgcacagccaaggcttgttcgccagcacaatatccaggttcctgaaatcagagtcacagaggaacctgacaagccggagaaggagaaggaagctcctaccaaggagcctgagaagccagtggaggaattccagtggcctcagagaagcgaaactctttcccaactccctgctgagaagttgcctcccaaaaagaaacgcttgaggcttgcagatttggaacactcctcaggggaatccagctttgagtccacaggcaccggcctctctaggagtcccagccaagaaagcaacttatcccacagttccagtttctccatgtcctttgatagagaagaaacggttaagctcactgcacctcctaagcaggatgagagcgggaagcattctgagtttctgactgtccctgcgggttcatactcattgtctgttccgggtcatcaccaccagaaagaaatgcggcgttgctcctccgagcagatgccctgtcctcacccgacggaagtcccagaaatacggagtaaatcgtttgattatgggaacctgtcccacgctccagtggctggaacatccccatcaacactatcaccgtcccgggagaggaagaaatgctttttggtgcgtcaggcttccttcagtggctccccagaaattgcccaaggtgaagccggcgtggaccccagcgtcaagcaggagcacatggagcacttgcacgctggcctcagggctgcgtggtcctctgtgcttccacctctgccaggggatgacccaggaaagcaggtcggtacttgtggcccactgagctcagggccaccactccaccttacccagcagcagatcatgcacatggacagtcaggaatctctgagaaatccgttgattcaaccaacatcctacatgacgagcaagcacttacccgaacagccacatctgtttccacatcaagatgcggtcccattttctcctatccagaatgccttgtttcagtttcagtacccgactgtgtgtatggttcatctgccagctcagcagcctccctggtggcagacacatttcccccatcccttcgctccacaccctcagaacagctacagtaagcctcccttccaagctgaccttcattctagctaccccttagagcatgtagcagaacacactggaaagaaatctgctgactatccccatgcgaaagagcagacttacccgtgttattccggaacatcagggctacactccaagaacctccctctgaagtttccatcagacccgggcagtaagtccactgaaacgcccacggagcagctccttcgagaagatttcgcctcagaaaatgctgggcctttgcagtccctaccgggaacagtggttcctgttcggatccagacccacgttccatcctacggaagtgtcatgtacacaagcatttctcagatacttggacagaacagccccgccatcgtcatatgcaaggtcgatgagaatatgacccaaagaacactggtaaccaatgcagccatgcaagggataggattaaacatagctcaagtgcttgggcagcacacgggcttggaaaaataccctctttggaaagtacctcagaccttacccctgggcttagagtcctctatccccttgtgtttaccgtccacctcagacaacgcagcctctctcggaggaagcaagcggatgctctctccagccagcagtttggagctcttcatggaaaccaagcaacagaaacgggtgaaagaggagaagatgtacgggcagattgtggaagaactcagtgccgtggagctaaccaactcagacatcaagaagggcctttcccggccccagaagccccagctcgtgaggcaggggtgtgcttcggagccaaaggatggctgctcccagtcaaggtcttcttccttctcctccctgtcaccctcctcttctcaagaccatccgtctgccagcgggcccttccctcccaacagggagattcttccagggtccagggctccgccgcgacggaagttcagcgggccctcagaaagcagagagtcctccgatgagctggacatggatgagacgtcgtcagacatgagcatgagccctcagagctctgcactgcccaccggaggcagtcagcaggaagaggaagggaaggcccgcaagctgcctgtcagcatgctggtccacatggcctctggtcctggaggaaatgtggcaaattccactcttcttttcacagacgtggccgatttccagcagatccttcagttccccagtctgcggacaactactactgtgagttggtgcttcttaaattatacaaaacccagttttgtgcaacaggccaccttcaaatcctccgtttatgcttcatggtgcattagttcctgtaacccaaacccatcaggattgaacaccaagaccacgctggcccttctgagatccaaacaaaaaattactgcagaaatttatactctggctgctatgcacaggcccggagctggcaagctcacttcatccagcgcctggaagcagtttgcacagatgaagcctgatgcgcccttcttgtttggcaacaaactagaaaggaaattagcaggaaatgtcctaaaggaaagagggaaaggagagattcacggagataaagatcttggatccaaacaaactgagccaatacgaattaagatctttgaaggggggtacaaatccaatgaagattatgtgtatgtcagaggacgtggacggggaaagtatatttgtgaagagtgtggaattcgctgtaagaagccaagtatgctcaaaaaacacatacgcactcatactgatgttcggccttatgtatgcaagttatgtaattttgccttcaaaacgaaaggaaacctaacaaaacacatgaaatctaaggcccacatgaaaaagtgtctggagctgggcgtgtcgatgacatcagtagatgacacagaaacagaagaagcagaaaatatggaagagttgcacaaaacatctgagaagcacagcatgtccggcatctccactgatcaccagttctccgatgcagaggaatcggatggggaagatggagatgacaacgatgatgatgatgaagatgacgatgactttgatgaccaaggagatttgacacccaaaacaaggtcaagaagcaccagtcctcagcctcctaggttctcctccttgcctgtcaatgttggcgctgtagcccatggcgtcccttcagatagctctctgggacattcgtcattgatcagctatttggtcactctaccgagtattcaggttactcagctcatgacacccagtgactcttgtgatgacactcagatgacagaatatcagaggctgttccagagcaaaagcacagactctgaaccggacaaagacaggttagacatcccaagctccatggacgaagaggccatgttgtcttcagagccaagctcctccccaagggacttctccccctcaagctaccgttcctccccaggctatgattcttcaccctgtcgagataattcgccaaagaggtatctgatacccaaaggagatttgtcacccagaagacatttatcacctagacgagacctgtcgccgatgaggcatctgtcaccaagaaaagaagctgcattgaggagagagatgtcccaaggggatgcctcaccaagaaggcacttgtccccaaggagaccattgtctcctggaaaggacattacagcaagaagagacctctctcccagaagagagagaagatatctgaccaccatcagagcaccgtctcccagaagggctttatatcctaaccctccattatccatgggacagtatctacaaacagagccaattgtattggggcctcct

SEQ ID NO: 2025 - protein, 2107 aa, Mus musculus
ILSRSEMQLRRSWFWFWESWPRLARAYIKSQRSNTHLHRPSPYPCQHSLSFPQHSLSQGMTHSHKPHQSLEGPPWLFPGPLPSVASEDLFPFPMHGHSGGYPRKKISNLNPAYSQYSQKSIEQAEDAHKKEHKPKKPGKYICPYCSRACAKPSVLKKHIRSHTGERPYPCIPCGFSFKTKSNLYKHRKSHAHAIKAGLVPFTESSVSKLDLEAGFIDVEAEIHSDGEQSTDTDEESSLFAEASDKVSPGPPVPLDIASRGGYHGSLEESLGGPMKVPILIIPKSGIPLASEGSQYLSSEMLPNPSLNAKADDSHTVKQKLALRLSEKKGQDSEPSLNLLSPHSKGSTDSGYFSRSESAEQQISPPNTNAKSYEEIIFGKYCRLSPRNTLSVTPTGQERTAMGRRGIMEPLPHLNTRLEVKMFEDPISQLNPSKGEMDPGQINMLKTTKFNSECRQPQAIPSSVRNEGKPYPGNFLGSNPMLLEAPVDSSPLIRSNSMPTSSATNLSVPPSLRGSHSFDERMTGSDDVFYPGTVGIPPQRMLRRQAAFELPSVQEGHMESEHPARVSKGLASPSLKEKKLLPGDRPGYDYDVCRKPYKKWEDSETLKQSYLGSFKQGGEYFMDPSVPVQGVPTMFGTTCENRKRRKEKSVGDEEDVPMICGGMGNAPVGMMSSEYDPKLQDGGRSGFAMTAHESLAHGHSDRLDPARPQLPSRSPSLGSEDLPLAADPDKMTDLGKKPPGNVISVIQHTNSLSRPNSFERSESTEMVACPQDKTPSPAETCDSEVLEALVSPEWAPPGDGGESGSKPTPSQQVPQHSYHAQPRLVRQHNIQVPEIRVTEEPDKPEKEKEAPTKEPEKPVEEFQWPQRSETLSQLPAEKLPPKKKRLRLADLEHSSGESSFESTGTGLSRSPSQESNLSHSSSFSMSFDREETVKLTAPPKQDESGKHSEFLTVPAGSYSLSVPGHHHQKEMRRCSSEQMPCPHPTEVPEIRSKSFDYGNLSHAPVAGTSPSTLSPSRERKKCFLVRQASFSGSPEIAQGEAGVDPSVKQEHMEHLHAGLRAAWSSVLPPLPGDDPGKQVGTCGPLSSGPPLHLTQQQIMHMDSQESLRNPLIQPTSYMTSKHLPEQPHLFPHQDAVPFSPIQNALFQFQYPTVCMVHLPAQQPPWWQTHFPHPFAPHPQNSYSKPPFQADLHSSYPLEHVAEHTGKKSADYPHAKEQTYPCYSGTSGLHSKNLPLKFPSDPGSKSTETPTEQLLREDFASENAGPLQSLPGTVVPVRIQTHVPSYGSVMYTSISQILGQNSPAIVICKVDENMTQRTLVTNAAMQGIGLNIAQVLGQHTGLEKYPLWKVPQTLPLGLESSIPLCLPSTSDNAASLGGSKRMLSPASSLELFMETKQQKRVKEEKMYGQIVEELSAVELTNSDIKKGLSRPQKPQLVRQGCASEPKDGCSQSRSSSFSSLSPSSSQDHPSASGPFPPNREILPGSRAPPRRKFSGPSESRESSDELDMDETSSDMSMSPQSSALPTGGSQQEEEGKARKLPVSMLVHMASGPGGNVANSTLLFTDVADFQQILQFPSLRTTTTVSWCFLNYTKPSFVQQATFKSSVYASWCISSCNPNPSGLNTKTTLALLRSKQKITAEIYTLAAMHRPGAGKLTSSSAWKQFAQMKPDAPFLFGNKLERKLAGNVLKERGKGEIHGDKDLGSKQTEPIRIKIFEGGYKSNEDYVYVRGRGRGKYICEECGIRCKKPSMLKKHIRTHTDVRPYVCKLCNFAFKTKGNLTKHMKSKAHMKKCLELGVSMTSVDDTETEEAENMEELHKTSEKHSMSGISTDHQFSDAEESDGEDGDDNDDDDEDDDDFDDQGDLTPKTRSRSTSPQPPRFSSLPVNVGAVAHGVPSDSSLGHSSLISYLVTLPSIQVTQLMTPSDSCDDTQMTEYQRLFQSKSTDSEPDKDRLDIPSSMDEEAMLSSEPSSSPRDFSPSSYRSSPGYDSSPCRDNSPKRYLIPKGDLSPRRHLSPRRDLSPMRHLSPRKEAALRREMSQGDASPRRHLSPRRPLSPGKDITARRDLSPRRERRYLTTIRAPSPRRALYPNPPLSMGQYLQTEPIVLGPP

SEQ ID NO: 2026 - DNA, 43173 bp, Homo sapiens
gccagcaaacggttgatttgaggcaagaagaataaagtttaaaaaagaaaataaatctagcatttgcttaataatttgccctttgcagcaccagaatcttatgtgaccacccacattcatctggttactgacgtggttcttgcttcaattgcagaagctatttttgcaccttttgtgtcttttgaggaaccgagtgggcctacttgcttataatgattcatgtctcaagtgcacagggtgtcctgaagtgctactgcagtggtgtgcagaaaggagggggaaactgaagcaaactacttcctttaagcactttgaatgttcacatgaagtggtactgcaggaaagcacactttaactgttatgttttaatgctttagttattcttatgggagttttgtaataacttgtcaggacaaaagggcgatttttttaaaaaaataacaaatatacgattatgggtattataatattatttttaagtaggtcttttatactgggagataaactctgttaagattgttgattaatctattcagattaggtagtttgatcttccatgcatttctttggatcatacttgaataaatattaattccatatatgaaaagttcctttcttcattacttactagacttttaaagtctgaattttgctttggttgggtttggattcctatttcagaatttaattttagcacaaagtataacattgctgaaataaactatagaaacaaatttacaacaaggttatctgagacttcatcctgcgaggtttagttgctaatacacccaaagaagttctgtagaaatctcagctttgtggcagaaccgtatcatggactacaatgacacaatttctagtgctggtacttgaagttttaactctagcatttcactgttacagggaattccctttaattacaagtatttattcaaaagatttaaactatgttaaaagaaaggaaattctttcctgggggcaaaaaaaaaaagcttcttgagagatccagttccaaattttctttcctaaaggaaggcaggttctgtgagtgaagaagaatgagcgtgcttattaaattcattacagatgtcatcatcttttaaatcttcttattcatcttttagattcccagaagttgtgcatgagttcctgtgaggagagttggcatcttggaaatcaaagacggttgtgatgcagttttttgatatgaggataacaggttaataactaaaatttatttattcttactctcttgttacattaaacttgaaaagctgttttggcctactatggactcatatataaactggagggaggaaacaatatattttccatctagagagaaaagtgttgttttgttgtattttgtttttcatagtagactagtctttttttttttttttttttttttttgtgacggagtcttgctctgtcgctaggctggagtgcagtggcacaatcttggctcactgcaacctctgcctcccgagttcaagtgattcttctgcctcagcctcccaagtagctgggactacaggcacctgccaccatgcccggctaatttttgtatttttagtagagacagggtttcaccatgttggccaggatggtctcgatctcttgacctcggcctcccaaagtgctgggattacaggcgtgagccactgcacccagcccaccaatcttaattataattaattatcattgttataattaaaatagcattattcgacagaatttatttctgacaaagtttattttcatgttagactctacttagtgaatcctaataacttttgctgtataatgagaaaacatctcagtagaaaagtgaaatcacaatttaaaaaattattttaaaaggtatgacaaaatattaaaagcagcatgctgtagccaaaataagtcataaatatcttgactaaataggcaaactctacaaatatatgcaatgatgcctgcattgcagcccatgtgaaaaaatatgtttgtttctcattaggctttaaatatcaaattagattttaattacatcaaattagaggatgatcatcacagtatttttacttttctccaaaagttttctgaattgcttggcaggattgtatataatagagttttctccatatagacaacttgctcattttggagagaactgaggttgttatgggaatttttactaaaagaagcctttataatgaatttggctctcaggaagccacctttttaaaaatcatcctgtggaaataagtctttattcagctggactctggcactcatcacgccttctttcttggtagttcctttttcccctcatcccatactctctgagcatatatgctctgagcggtggttgggcaatgagtgtctaagtgactcgtgggatcaatgttacaactacaatgccccgagatgttcatgtattttttaaagattttacaactgatctgtggcactttaataacaaatacaatgatgtcccttctaaaatgtcattcactaattattaccataagacacgtattttgtttacaagtgtcaaaccacaaatcctcaacaaaagacgaaatgtttagaagtgtcataccaccaaatcctcaagaaaagaccaagtgaccatttacatttttaaaaatgttttattattaaaatgttggaagtggagaagccgtgtttgctgccagtcattgtataccgtcattatttaggatgtcattatttaatgctcacttgacttttgccaccactcaagtaatgattaatttcctgaggtaaggtttttttctgagataatgttttcctaagcaaaagatcccagattgacaaccctgggtactgtaggtctttattcctctgcagagtaagcctgtcttcctgccaatcccacccagccgttatcctgaagagacctctgaggaggtccatctaggaggctgtttatgtgtctttcctttgggaccctgtctggggaaattatttaactgggtgccaaacttatttgagtgggactctgaagagtggccaaaggagagggcacacttctagaagaatgcctgctcttccctgtaatatcattttctttcgcttcagttcctttagttccattaccactgaaatagccatgcagaggtaatctcttttttaacatgatccccctctgaaaagtgtgatgagcctgccagacaatgtctgtctttactgactagaggactcctgtgggctgtagcagcatccacaggaaacccaaagtcatatcccctgagttttattctccagtaaattatcttactcctttcatagcacttaaaacccactagagaaaattttaactgtgaatgcaaaactgtatttggaattccgctcctttgttggcagtgggtgccaaaaatgactttgtgtgggtttggttaccataaaaggaaatctcagtgaataaagtgacgactcgctgttttcatatgagaattactctcatactgcattttttgatatatcaattgattaggaaacctggtatatattttaatgaaatattagagaatctgaaaaatgaattgactctacacagtcatagagaaatactgtagctataattaaccatattactatagatctttatagttctaagtggatctctgttgcagaaattaaactaaaattgcaggtagatacaatggtacatttaatgacttgtaataatgttatgaagtccaaagaaagtattttcctgacttaatgattcatttaatgtagatttccttatctaacatacttttaaaaatgttttgttatctataagcatttttatacattttagtaataaaatgtaagctcaagaatttatgccatttggaagagttaagttgcttagtaaaagtgtcacctaacaaaacaagacaaatgccattatctaatcttgaaaaccctattgtttttaaagtgaatttattttcctcagtataacatgagtggagtagcagagaaactttcaaaccctcccaaatcctgcttgtttttaaagagaaagtcatgccatgttcagtaatagattatgatgcacacaatttccattgcagaatcttttcagtttccaggataaagcagctgtagaaaagtgacaaatacaaatagtccatatttttaatggttcataaatatgatcaataaattctaaaagaagccatcgctcactttctctcccacctacctttctttatatgtctcagaaactccaagaagagacgtgattttatggatagcagttagtcaaaggctccccaaggatagtgttggagagaaaaagacatcctcaaacatgtttcaaatcaaatgtgaaagttcatgtgaaataagcatgatttctagttccctaataagcctttcactgaagtgaaaaactagacattgtggatcagaggaggggtccctgtagtgctgggacctccagcttaggcacaaagatggaagctcttcccgcacaacccaggagagaaagcatggcgtgggatatcacctagcttcctggtaaaatggtggggcatctcgggtaggcttgtcttagaaatttaaaaggaagagattttcttgacagaagctatttgcataattgagttaatgttttgaatcttaaaaactttctggataataaatgctgttggaatatagaaagatcctatgttaaacttagcaaaattattttttaaaataaagtgatagataagactttttttctgattatcctccttctcctaaaaattaaacaattaacttaatggtctagacatgttttgttctgaccatgaggtatctggttttgaattttgtgtaagtcactttttttcaacttctggtgtattctctggtagcaaaatattatttctgaattttatttgatgcatttactatatgatatgcccttagtgtataagaatggttttattattttataccataaaaattaaatgtctgatttataaaggtattacctcattgctaagtgaaaacattatattttattgaataacttatgaaataaattattccaaccctgttttttataaaattgtatgtacttattacttgaagtttatgctgttttttgttttgtttgtttgtttgttttgagatagtctcactcttttccccaggctggagtgcagtgctgcaatcatagctcactgcagcctcgacctgctgggctcaggtgattctcccacctcagcctcctgagcagctgagactacaggtacacgccaccatacccagctaatttttgtattttttgtagagacggtgttttgccatgttgcctgggctggtctcgaactcctaagctcaagcgatccacctgcctccacctctcaaagtgctaggattacaggcatgagccaccatgcccagcccctgaagtttatgttttgagcaaaattatatattctgtgtcaaccaaaagatagaaaatgatacatacctgattttcacttgtaaggttcttattttccttaaaactaatgatttccaagctgggcacagtggcttaggagctacttgggaagcagggcccagaggatcccttgagcccatgagtttgagtccagcctggacaagaaagtgagacccccctcctctaaaaataaaagtaatgattttcaaagaacaaaagaaaacagtctggcatgagactttattatggtcttacaagaagctgttctcattaatacttaatatacatattttgaacattatttaaattatggatttttttatttctaggaaatggcattttggggccattttttgtactacaaacatgcagagctcatttatattctctcagaaccattaaaagttgagacatttcatatattaaagttaagtggaaatatttagatgaagatattattgaagatgtattattttaagttgtaataaaacttaatggagagtagtggtgagtcctcccagacttagaagtcaccaaatttagatctgaattttgattctgaaacccaacctctctaagaatcattctcaactgtaaaataggtgtaataatacccttagcatagaggtataatgaagataaaataagacaatgtatatgaaactctttaacagtatgtatcagcccatggtaaatatatagtaaatgacagtcattatcattgttataattaacaatgaaactgcatacatagatcaataccatgataaaatattaaatctgaaaaataacttagaaattattcacttcaagctctgagtcctaattgaggattcatacatgcttgtcttgaattgaaaatgtagtatatttccattttagagggtatttatttacctctacaagtctggcagaggttgtgtctacatgaaccttaaatatttagttaattaaacacagtcagccaatttagattcaacattgtgtcttcttcttgttagcatggttcctggaattgacacaaggaaatttgcattggaatattatgagactatcatttgtgtttcgtttttgcctcatttcctgcagagggatgctaaagaaaattattgcacagcaaaaaattaaatccaatagcaaaactttttagcaaactgagattaatatctttgtttagtattttgactgctgctttacaaatctcttaggcttcatggccattaacagaaggaatctttgagtacagatgtcttactacaaatatctgggggctactgatttctcacccaaaagacttaccgttcctgtgggaatttccgggtgcttttcccctctcaaagtgcaacttctgtcatcatcatcatcacagtcaaattcgatgttagggagaaaattgcccatggaagtaagactactatttgagtttcgctttaggaatctgcagtacatctgcatggtagcattttaaaaaattattaactagtgttttatttaaaaagataaacatgctcatgttaagaaaaataaacaaaaattaaacttactgaaagtcatgagatggaaggtaaaaatcctttctttcctcttcctctgaatcccaggttccacttttttttttttttttttttttttttttttttttttttttgagatggagttttgctcttgttgcccaggctggaatgcaatggctcgatcttggctcactgcaacctctgcctcccgggtccaaacaattctcctgcctcagcctcccaagtagctgggattacaggcatgcaccaccacgcctggctaattttttatatttttagtagaaacagggtttctctatgttggtcaggctggtgccaatgctgcctggcatcctcacaggaattttctgttgatcaactgttcctctttttcacccataggattaacaatgtgtcttcgtactagggtgcaataagcttttcttgcatttaatgttactatcccctgaacaagtttctatattggtacttatagctgtactttatttattttaaatgcctcagttttatcattgagccataatttatttaagcggttcttgtacatatatattggtgtgcgcttgtgcaagtacacctgtaaggatatatttccagcagtggaatttctaggtcaatgtgtatgatcttttttattttgataaacggacacattgcctatcaaggaaacatctgaggttctatgacagtggatacagtttatcattgaagttctcagaatcctctgggtacctcattgaacactcccctaaggaagttgagtattcacttaaaattgaacgattacttagttgtcaagtcttcctgagccatacgccatcatctagaggactccttcactttgctatgatgtaaatttcctaaaagggaaatttattcttttaaacataaacattcaaacctatcagaaaaaaaaacccactattttcatccaggcgaggtggctcacacctataatcctaacgctttgggaggccaagatgggcagattgcttgagcccaggagtttgagaccagcctgggcaatatggcaagagctcatctctacaacaaaatacaaaaattagatggatgtagtggtgcatgcctttagtcccagttacttgggagcctgaggtgggaggatcacctgagctcagggaggtcgaggctgcagtgagcagtgattgcaccactgtactccagcctgggcaccagagtgagactctatctcaaaaaaaacaaaacaaaaaacgcctgtatctcaacttttaatatctagggaattagaactaggctgattacatttaagtaactaagatgtttcatatataataatcttatgtcttagaaaatattactatgatgtttttataatattttctctgagttatttttgagtcacagtgtcagtgtaaggtttactcttctggtgtaatgctttctgaagcagtttcttgctttcgttttagggtacatagcattgtgaaccctttatataatgaactggaaattggaatttgtatttgtatatatcgatggtaaggtttaatggaacaattttccctaactgcatttattttgtatccaggaagcgtcaggacaatcatgcccataagaactctaaactgttcaggtaatcatttcgtttttaaactgtcctagaaatatgctttgttttctatattaagaagactttataattgttttgtttagatgcacccttttatcttttccaaagttctgtgacatctaattcttatagccttgatgtcattttattaatcactgattttaagctgtaaaatatagttatactttatagtaatatataatactttatgaattatgtattttataaaacatgtatcatatatgtatgcttatatgtatactatgttatatttatattttatattaatatgtaactatatatatggtttttttttgagatggagtctcgctctgtcgccaggctgcagtgcagtgacatgatgtcagctcactgcaacctctgcctcccgggttcaagcaattcccctcccttagcctcccgagtagctgggactacaggtgcatgccaccacacccagctaatttttgtatttttagtagagacggggtttcaccattttggccaggatggtttcagtctcttgacctcgtgatccacctgcctcagcctccccaaatgctgggtttacaggcgtgagccaccatgcctggccacatattgtttgtattaagctataaaacatatctctatatagagatatgtaatacactttggcatacaagtcataaaacttggttaggaatagctctatttttttttaatggggctttctaaaaccttatacttttgtagataatatccatcaaggattttccttcaaatggttttctaaagttaaaaagtatttaaaagagtgaccaaaattcaaacatggaagagacttatgttcatgacttaatgctgagtttgaaattaatatattttaattgtggaattaatgtaatctcaataaaaataattccttggagtaaaaaacatttcaaatttatctaatttctggttggttagttaggtttttttttttttggtttcttatttgaaactgttatgacaatctctttgtattttctttttcttcagatcattttatcttagtgaaactggcaattgaactttgctctagttgatgggcaaaatttctcctagactattcatcatcccaatttcatcctagttgaaaattttcaaatgccataagaaatctttatagatttgcacttagcttttggatggacgtttctacaatggagagaactgtgttatagccctggtccaaggacattactagctaatgcccatcgactgtggtgtgcgtgtggaaggttccaaagagaaggagcaatcagcaagtttgcagacaccctggaacatggaagcaaccaagctttaagaagcacagctttggagacactccatgagtctgcactgctttcaggggaactagcacttaagaccttgtgtaacaaaatggacactggggacacagctctaggacaaaaagctacctcaaggtctggagaaactgataaagcatcaggtagatggagacaggaacaatcagctgttattaagatgagcacttttggcagtcatgaaggacagcggcaaccacaaatagagcctgagcaaatcggaaacacagcatcagcacaactgtttggttctgggaaactggcctcccctagtgaagtggtgcagcaagtcgcagagaagcaatatccaccgcatcgtccgagtccttactcatgccaacactcactctctttccctcagcactcattgccacagggggtcatgcacagcaccaagccacatcagagcctcgaaggtcctccgtggcttttccctggccctttgccatccgttgcctctgaggacttatttccttttcctatacatggccacagtggtggttatcctagaaaaaagatttcaagtctgaaccctgcttatagccaatactcccagaaaagtattgaacaggcagaagaggctcacaagaaagagcacaaacccaaaaagcctggcaagtacatttgcccttactgcagcagagcgtgtgccaaacctagtgtactgaaaaaacacatcaggtcccatactggggagcggccatatccatgtataccttgtggtttctctttcaagacaaagagcaatttgtacaagcacaggaagtcacatgcccatgcaattaaggcaggattagtacctttcacagagtcagctgtatctaaattggacctagaggctggttttattgatgtagaagcagaaatacattcagatggtgaacagagtacagacacagatgaggagagttctttatttgccgaggcttctgacaaaatgagtcctggtccacccatcccactggacattgccagcagaggcggctatcatgggtcattggaagaatcattgggaggtccaatgaaggtgccgattttgattatccctaaaagtgggattcctctccctaatgaaagctctcagtatattggccctgatatgctaccaaatccatctttaaatactaaggctgatgattcgcacacagtcaaacagaaacttgcactaagactgtcagagaaaaaaggacaagattctgagccatcgctcaaccttctgagcccgcacagtaaaggaagcactgattctggttacttttctcgctcagaaagtgctgagcagcaaataagccctcccaacacaaatgcaaagtcttatgaagaaatcatctttggaaaatactgtcggcttagtccgagaaatgcactcagtgttacaaccacaagtcaggagcgtgccgcaatgggtaggaagggcataatggaaccattacctcacgttaacaccaggttagatgtcaagatgtttgaagatcctgtttcacagctgatcccaagcaagggagatgtcgaccccagtcaaacgagcatgctgaaatccactaagttcaacagtgagtccagacaaccccagattattccatcatctatcaggaacgaaggaaaactttatccagcaaacttccaaggcagcaacccggttctcttagaagctcctgtagactcttcaccccttattagaagcaactcagtgccaacttcttcagcaactaatctaactattcctccttctttgagaggaagtcactcatttgatgaaaggatgactggttccgacgatgtattctatccagggaccgtgggcataccccctcagcgcatgctaagaagacaagcggcatttgagctgccttcggtacaggagggccacgtggaagtcgagcaccatggcaggatgttgaagggtatcagcagttcatccctgaaggaaaagaaattgtctcctggggacagggttgggtatgactatgatgtctgtcggaaaccctataagaagtgggaggactctgaaacaccaaagcaaaactacagggacatttcctgcttgagttctttaaagcatggtggagaatatttcatggatcccgtggtgccattgcagggagtaccaagcatgtttggaactacctgtgaaaacaggaaacgccggaaagagaagagcgtaggggatgaagaggacacgcccatgatctgcagcagcattgtaagcactcctgtgggcatcatggcttccgattatgaccccaaactgcagatgcaggaaggagtcaggagtggatttgccatggctggacacgaaaacctttctcatggtcacacggaacgctttgacccatgtcggccccaactgcagcctggaagtccatctcttgtgtcagaggagtcaccttcagccattgattcagacaagatgtcagacctagggggcaggaaacctcctggaaatgtgatttctgtgattcagcacaccaactcactgagccgacccaattcatttgaaaggtctgagtcagccgaacttgtggcttgcacacaggataaagccccttccccttcagagacttgtgacagtgagatttcagaagccccagtgagtcctgagtgggctccacctggggatggtgcagaaagtggggggaaaccctctccatctcagcaggtgcagcagcagtcctatcacacacagcccaggctagttcggcaacacaacatccaggttcctgagattcgagtgaccgaggagcctgataaacctgagaaggagaaggaagcccagagcaaagagccagagaagcctgtggaagaatttcagtggccccagagaagtgagaccctttcccagctccccgcggagaagttgccacccaaaaagaagcgtctgcgacttgcagatatggagcactcctcaggggagtccagctttgaatccacaggcacaggcctctcccgcagccccagccaagaaagcaacttgtcccacagctccagtttctccatgtcttttgaaagagaagaaaccagtaagctttctgcacttcctaagcaggatgagtttgggaagcattcagagtttctgactgtccctgctggttcatactcattgtctgtcccaggccatcaccaccagaaagagatgcgacgctgctcatcagagcagatgccttgtcctcacccagcggaagtcccagaagttcggagcaaatcatttgattatgggaatctgtcccatgctcctgtgtcgggagcagcagcctccacggtatcaccgtccagggagaggaagaaatgctttctggtgcggcaagcttccttcagtggctccccagaaatctcccagggcgaggttggcatggatcagagcgtgaagcaagagcagctggagcacctgcatgctggcctccggtccgggtggcaccatggcccgcctgctgtgctgcctcctcttcagcaagaggacccagggaagcaggtggcgggtccttgtcccccgctgagctcggggccactgcacctggcccagccacagatcatgcacatggacagtcaggaatctttgagaaatcccttgatccaaccaacatcctatatgacaagcaagcacttacctgaacagccacacttatttccacatcaagagacaattccattttctccaatccagaatgccttgtttcagtttcagtatcctacagtttgtatggttcatttaccagctcagcagcctccctggtggcaggcacatttcccacatccctttgctcagcaccctcagaagagctatggcaagccctcttttcagacagaaatccattcgagctatcccttagagcatgtggcagagcacactggaaagaaacctgctgagtatgcacacacgaaagagcagacctacccatgttattcaggagcatcagggctacacccaaagaaccttcttccaaagtttccatcagaccagagcagtaagtcaactgaaacgccctctgagcaggttcttcaagaagattttgcctcggcaaatgctgggtctttgcagtccctcccaggaacagtggttcctgttcggatccagacgcacgtaccatcctatggaagtgtcatgtacacaagcatttctcagatacttgggcagaatagccctgccattgtcatatgcaaagtcgatgagaatatgacccaaaggacactggtcaccaacgcagccatgcaagggataggattcaacattgcccaggtgctggggcagcatgcgggcttggagaagtaccccatttggaaagcacctcagactttgcccctcggcttagaatcctccatccccttgtgtttaccttccacctctgacagcgtggccaccctgggaggtagcaagcgaatgctttctccagccagtagcttggagctcttcatggaaaccaagcagcagaaaagggtcaaagaagaaaagatgtacggacagattgtggaggagcttagtgctgtggagctgaccaactcagacatcaaaaaggacctctcccgcccccagaaaccccagctggttcgacaaggatgtgcttctgagccaaaagatggcttgcagtcagggtcatcttccttctcctcgctgtcgccctcctcatctcaagactatccttctgttagcccgtcttccagggagccattcccgcccagcaaggagatgctttccggttcccgggcaccacttccggggcagaagtccagtgggccttctgaaagcaaagaatcttcagatgaattagatatcgatgagacggcatcggacatgagcatgagcccacagagttcttcattaccagcaggagatggtcagctggaagaggaagggaagggccacaagcggcctgttggcatgctggtccgcatggcctctgcccccagcgggaacgtggcagactcaactcttcttctcacggacatggcagatttccagcagattcttcagttccccagtctgcggacaacaactactgtgagttggtgcttcttgaattatacaaaacccaattatgtgcaacaggccaccttcaaatcctcggtttatgcttcatggtgcattagttcctgtaatccaaacccatcaggattgaacaccaagaccacgctggctcttctgaggtccaagcaaaaaatcactgcagaaatttatactctggctgctatgcataggcctggaaccggcaagcttacatcatcaagtgcttggaagcagtttactcaggtaacaaatactgttttaggaagaactttgtattgtggatttgattgctgagcagactacatagtgaaggatataaggcctaaaaaaaaaatacaagtaaaatgaaggtcagtgtgggggcgttttcagaaagtctggccttactcaggagtggaagaagccactgactgcacttggttctgaggtctcaggcatggtccattttcagaagaaaaagcctacatttatgcttttaaaatttaaaaatttgggtgccatgaaatcctaccactgggattaattcccatgggttattttccttctgacctttgtgagtgacctagcaggtctaattttctctggatgtgaggaattcagggaattgtgaagtgggccatagagcagggaatggaggctgaaaggaaagacgaagaaggaggaccgagctttgcaaatgctgcagggcttactctcattgacgagacatctgtctccttcaaaacttatttttccaagttgctggctggtttattcctacaagaaccatcaatgccttccatgtaaaattataaaaatattaaggggaattttgaaatttctgctaaattaataaggaggcaaatagaggatttaaaaatatgttttcacttttatcagttaccattttcccttcaataatttttgagactacttccttaattaatatagattgttttcattgctacttcaaaacatagaatgtgtcttttaagtattagcattgcacagagtgctgagtgtatatgtgtatctatatatttttatatataatatatgtacttattatatatagctgtaacagaatgttgaatttattcagtggaaactgtcattcttatctgattttatccctagtggtccttattttatataactagttcctggccttttagtacagaatttaggctcattttcagagatgatggaagagtgggacataggggctcctgtgtcttggagaaagcatgtgaaatgattctctcttcttgtcttacagatgaaacctgatgcgtcctttttatttggcagcaaactagaaaggaaactagtgggaaatatcttaaaggaaagagggaaaggagatattcatggagataaagatattggatccaaacaaactgagccaatccgaattaaaatatttgaaggagggtaaggaaacaaagtgcaaatgtaaaatgtgcagttataggtcagagtaaatggtccagaatgtctgcatggaaaaggtactgtctaatctggttgaaagctgaaagtaaattccttttctattcacagttctgaactctggctggtaatagatcataagttcatgcccttgcctttgggatttgctttgcaagaaaatgtccctaatggatatcattcaagcctcttccttaaattttcacccctctaatttattatgaaatctactaaattggtggacacttgatgtcatctaagtttgttcattctttgatcattttataggtatttgttttattgacggacatatttttattgtatgcttacaaaaatcagatcatgcacaatcatgtataatcttcagaactagttaatttgtttgtttgtttttcttattatctaaactagaggctttaatgggatttcaccagttccatcaatatccttttctgtcccaggatccaagtcagggtaccacattgcactcagttgtcttgccttttcagtcttctctggtgtatgacactttctctgtatttaggaatttcttttcaaatcttgagtcctgagtcatagaaactcaagtaataaggttcaaagactttgttatttgtatagttaagaaaaattacacatatgtaatgtcttgttttagattttgatagaaatgtatctttcatccagtcacatagaaggaaaagcctacacttatgcttctaaaatttaaaaattttgaagcgtgctaaccacattttggagattatgatgtaattagccttatctctacaacaaatctattatttacatatcttcatgggcatgactttattccaattatatttggaggaaataatgttacttgtttgactataaaatgtggaatgttcagtgagatgaaatatccatttctcacctagcattaccggtttggagatggattattctatttggttgtcccttaggttttgccctctttggatatctagcattttcaccactaaaaccacaattgtatgtagtcatgaagcttgtcttgatatttttttgacatcccccatcttttaacacaaacgagagaaatatagattttatctctcctcagagactgagaggtccctgtgactgaatcaaccctctcacattcagcagccttcatagcagtgtacttgcaccaatagattagcgagaactccacaattactgtatgctttggggagcccatctccactaacgaaggacacaagtgaaaaagcgtatgtgaacattttattgctgtgttttggtgatccaaaaggattgtgcccatatttcatttcctcctcctttaattgccccgttttatgggctgtgtcccattacttcttaatctgtggcccaatttctgcccagtggtgaccaagtgttttttccaaaccttgtgttacctcctcttattttggcaattgcaaagtgatagctaaaaaaataaaaagtattactgaccaaaattgtaagtgtatattgtctaactgataggtttaataataaattcaataatttagttaaacacagctttgaatgtttttcaaaatccatcaattaccttatcaagtagattcatgggcctgtagaactgttgtatgatatattatttataccagtttctctaatacatcattatattttatacagaattttactgtattttcattctggaagcaagttaatcagctaagacattgaaaataaaattatactgcttgatgataaaatgcatttcccatcactatgatggcaggctatagtaagcttgaagtatccttccttgaagaaaattagctttgtacaaaagtatttgttttagtctatatgtcttaagcaatttcatctagttaggggcagagaatagtgaaatttaaaggtgaaagacatttgcatctttagggttttttctactttattgcaaaagacaaagataaaattcaaaataattttgaagaacaagtggaagtcaaaattcctggtaaaaggggggaaatttaaaggaacggaagacatgcaaaattgattattcatagttttgaatagtttctacttaactctcatctggattggtactgaccaaaaagtagataacgttaagattagatgtgaatccgtaacagagttgctgtttaaatatgtggatggatttcctttcttaaaattatttcaatagattggatgactgaagttaaacttgcctttattcctgtttgtggattagctaggataaaatgaggaagtttgcaatgctcttagaatgtaaaaaaactgtaaatttagtgcctttaactaaatccacagtggattagggcattttgcatgtcagtttacctttggaagttatgaaaagaactccccaaatggagcgtctttccaaaaataacattagacccaaaattctagcctagctttgacttaagagataatgacagtcattgaattagtccgtataatactactatatcttatgacaaattatgttttattgtattctaaaatggaatggttgagcattgggtagatttcttcccttgattatcaaagaaaatacctaagactgtttttctagccgatttgattaagcaagatgacctcagatatcctttcaaacatctctatgaaacccttctggaaacaaatgcaaatttgattaaaaatagaatctctagttttcattatgtaactaccttgaagaagctagttgaaatttagactccacattattacagattcatggtctttgggaagagcagatcaaatctgtagacaacagttggtgagctgagctcaccctgtgtaaactagaaatttctgaggcactctcgtgccaggattgtaaaaatagagtaggaacttgcagtgaagaattctattatcagttatacttaatttagcaaatttagagggttgtatgtttgtacatgtacatcttagatgatgtaatgttaacaaaagatacatgatgaacatgttggtatgctttttgtatgtcccttgattggaggccatactagaatccagtccaaaggtctgcagctctttgaggtttacataagtcattttgaacatctacttcccaactctataaattcacatgtaatagtgaagccaattccattttgaattccatggagcattacattttgtttacagtgccaaatctattatctagttctttcagccatttactgcataaatttcacaggcttcgtagaagtaaagttgaataattgtctgcaaaagaccctcataaaactttgccgtgcaaataattagcttttgctttaatatatagcatgctaagaatatttgaaaacacactggattccctctttttaaaacaggtacaaatcgaatgaagattatgtatatgtcagaggacgtggccggggaaagtacatttgtgaagaatgtgggattcgctgtaagaagccaagcatgctcaaaaaacacatccgtacccatactgatgttcggccttatgtatgcaagttatgtaactttgccttcaaaacgaaaggtacaagtctgatttttttgagaggaaaaatacttctctatggctacttagatttctgagtgctattttataactaaccttcatcaacaataaagatagtttgtttgtgaaaatatgattccacgaaatatattttctccctcaagtaagtgatcaaaggatgtatgtgagactgtgaggctccttttatgacttaattaagagcagtagacataggtccaggccagttgtctccaaaggaagtggctacaaattgtctggatagctattacttcatgttggaaatgttatgtggtctagataatatttacaccagtattgaaatcctgcacatgcagtggtattagagaagcaaggcagcagctgggaagaaaacatgtgctcttggtcagtttcaagattataaataatgtagagacccacacactcccaggtgggtgccttcatccacagttgcattaattatgcatagaaatttgatagcttgtgttccctgtttttatcagcacagagacaatttctgattctcagtacataactgttagtcttataaaactaggacttgccttaaaatttttttttaaaatctgtttttaacaggtagatttatgtaaaaatattttactcaaggaagttgcttcggttatatttttattttttataatattatgaaaatgttcataagtctggtagtctcagaatacaaacagtagtgaattagaggttgttcgacttttgcagaagtgtgttttaccttaggtttagtggatactataggcaccccctcaacactttaaattttcatattgattaatctgctcattcaagaaaaagaaataccaagtaaaattatctttggtagagaaatgtatacctatattcttttatagctgaaaatcctaaattgctagaagtgtaaatgggtagcctctcaacatatctgtttctcttttattaaaaagatctatgtaatagaattgcctcatttgaagctgaaaaaagtatgtgttcatttgtgtctcaaaaaataatcatatggccttttaaataccactcacctctgcacaatcaagccttttatacagaactttactaagagattccctaggagataagaaaataaaaactttggtttcagggaatattgcaattcaatagtcattacgaatgatacatatcttcactgggcatatgagtttgctgcaggtatagttgtgtgaaaaactggatgaagaaatgacacatctctagatatttttaaaaatcaaattaagtctgcctctgaatcatcatctcctgaaggaaataatttattcttggtcattattggagtttccttgtcaccctttgggaatgtgcaaatgtctcagaatcttaaaatgagcaaaacatcctgggaaaccctgccagttttcacctccgactgaaatgcctgttgtccaaacccacattgtcgtctgagcacagatggaacgcccttgcatgaccaatcccttctccttgtctgtgccacttcttcaggggcctcccccgccactctccttccctctccttgtccttatacattacttctgcagctcatgactttaacaaactaaagccatggtagaattgtttcagatccagatttctagctacagacctattctgaagatgggagtctaaagcctgactatccttggaatggagagaaaaatgtaggagaaagaaacacatactaaaatctaaataaactatcccgatatgcttagcatctatacctatacacatccatagcgtacttgcactctggcacaagtgatgatttttattaatttgtagatacatttcattaattttctagatttaagcattcttgatatgtctataacatttttgggctctttaaaaaatggtagatataagttttgataaataggaggagtgggggcctggaaatatttctgtttggaatcattcaaaacagcatgtaaaatttataagtatataagcaataagtaaataataaagcaatatgagtaaaataataaacaacagtgtcccagttttaactgtggctcatatattacatgaacagcaagctgaacacccctaccagaggaataaactgtgctagcaggctgagtttccacggagatttcacagagccttctcttaaagtatttgttggtacattgctaaagcgttgtcaagggcacagataacattatggctattttcactgaagtgatgtaaaggcgccttacaactgaattagttcctgaatctcttttgataagttatatggcatataatttatatgtatgtgtgtgtgtgtgtgtgtgtgtgtgtgtgtgtgtgcattcttctgtagatcctgggtcaacgaggattggaacaatgttttcaaaatttctcacatttcataaagcagttatacaaattatatatataatttatatccacacatgcatatacacatataattgtatatgccattatcattataacatattcagcatgaaacctttcttttttgttagtgtgataggagcctgaagataagtaaagagggaatgttgctgctccagaattttaggaattgctgtcataacttttgctaacatatgccagacagatagatgctaaatactgggaataatgctccctatgagtagttagctaattatttgtatggatctttcagagcactgacaaggttggccctcacattagtttgtatgtatttttcttctgaatggtgaagatccttggaggttactctgtacctgatcagtcacagaaggtcaggggcccagtgggtgtgttgagaatatttcattctgaagtatctctgaggtgtgtggccagattgcgtttcctgtttatgtggagtcccaggaggctggtgtatttgggtagatatgaggtcccttctcaggcagaaaagcctgggatttctagtcttgctttgagcctactcttgaaaagatgtgagcctggacttccacatatcttctagaataaagaatatctgagattgggccaaagctctcagggattgatatcttcaaagaccagattattcttcttaaggttgaaacaaggggtagtgggtagaaacaaatctgtgttacatgatgaatttaataaaattagttcatttcacattgaatttggagcagctatcagcagttattaatttgataaccaattaatttctctcttttttttgctacattttcaaggaaacctaacgaagcatatgaaatctaaagcacacatgaaaaaatgcctggaattgggagtctcaatgacatcggtggatgatacagaaactgaggaagcaggtgtgtatgtcataaatgagttgacagacctcttcattatgcacagtggagctctgtggctgaggtagtaaaataagtttagatatttttaaaaagtgatcacttttcattttattaaatactaaatatagaaaataaaactgacacattgaattgcttgaaatctactgagaagaaatgcatttcagttttgactccgagggcaaaaaaggccttactttgaaaatacttatatttagagccttctatgaagggaatagaattgcacttgctttgtgatagcaaattagattttatgaggctttttgggaaatttgaaaagcattttaatgtattattattcaagttaagaagaaacccagtaggaaaacaaataaactagcaaacaaacatcattaaggttggccagacctcctgagatacatcacttagacatacgtttgtacctgagcttgcagagacaggttgttgcctttctttctcctctagcatcataattaacattatccatgctcatttgttgagggttttctgtgagtgggatgatgtctgagatataaagtcctactatggaatctttcttgtaagttggggatgaaaacaaatagatatacaagaagatagaatgaacgcagggtcacacaggtaagtgcctcattttataggagttctcagacataactatctgtgggcactagggattgggaaaagcgtttagaaagaaatgaggcttaaataagatcctaaccttgacatttggatcttgatctccattatctttgtttaattgtttcagaaaatttggaagatttgcacaaagcagcagagaagcatagcatgtccagcatttcaactgatcatcagttctccgatgctgaggaatcagatggtgaggatggagatgataatgatgatgatgatgaagatgaagatgactttgacgaccagggagatttaacaccaaaaacaagatcaagaagcaccagtcctcagcctcctagattctcctccttgcctgtgaatgttggcgccgtaccccacggggttccttcagatagttccctgggacattcttcgttgatcagctatttggttactttgccaagtattcgagttactcagcttatgacacccagtgattcatgtgaagatacccagatgacagaataccagaggctattccagagcaaaagtacggactcagaaccagacaaagacagattggacatacctagttgtatggatgaggagtgcatgctaccttcagagccaagctcctctcccagggacttctcaccctcaagccaccattcctctccaggatatgattcttcaccctgtcgagataattcaccaaagaggtatctgatacccaaaggagatttatctcccaggagacatttatcacctaggagagatctgtcacccatgagacatctttcaccaagaaaggaagctgcattgagaagagagatgtcccaaagagatgtttcaccaagaaggcatttgtctccaaggaggccagtgtctcctgggaaagatatcacagcaagaagagacctctctcctagaagagagagaagatacatgaccacaataagagcgccatctcccagaagggctttataccataacccaccattgtccatgggacagtatttgcaagcagagccaattgtattggggcctcctgtaagtataatccacttttctttctaatacataagtggaagcacattggtcctcctgataatgcactggtgtgaagtttagtagaacatgggtatctgtcatgggtggagtgaatctggctaatgaaaatagcggggagacatttttgtcatatgctattgtcagtaacatggctgtggcattacctaaagtgtagtattgcatcagagcagcagtgcattcccagtgggaacaggtgaggcctttctgaaggctttctaaacttaactaatgatagacgtaagctgaagcctttttgtaagtaaaaaagatgaacctttagaatgccatgactgcatggacatacactcacagggacatttaggcatcacttatataactcatcaccaggtaaggattctgattcagctgttaaccttgactttccaaaacttttatttttaaaatttttattttatttattttttttgagacagggtctcactctttcacccaggctggagtgcagtggcacgactttggcacactacaacctccgcctcccaggttgaagcgattctcccatctcagcctcccgagaagctgggactacaggcgtgtatcaccacacctggctaatttttgtatttattggtagaggcagggtttcaccatgttggccaggctggtctcgaactcctgaactcaagtgatctgcctgcctcggcctcccaaagtgctaggattacaggcatgagccactgcgcctggcctcaaaaactcctttttttaataaactctaccttgcccatcatgaggggacatgtgaaactggtcagggccagggagaggagagaatgacacactcggcatgtttataaatcaaagacatgagcctgtctgcttttcttgccattactactatcaagtgcacttgctcagtggaagcgtgggcccaaggagaacgggaaatcaggagagctaagtgagaatgtgcagagatttctatgatatgccttcattataagtgaagataacagtaaccaccatggattacatttaagcagtaggtttaatacaaattcatataaaagcacctgtcctgcctaattccacggctcagtagactgtgatgtctctttcagtttgtgtaggattttaaaaaatgaataaagcatgcacttagcatagacagaggcatgatacctttggaatctgtctgccttgaatgtgttttgatttcctggtttctactctttgttgtactcccttgctccggatctctgtgtcaagtgcatcagcaccatccttcacagccagaggagacactgccagctcccagctctgttttatcactgccctggcagccaattttctccctctcatcaccttccaccaccctgaatcctgagctcagcctgtcattttttcactttaggaaagctgctgcattcctgtccccatccccagcaccatcttttcacaagtctggtaccaacttcatcttgatgaagcaattcctgcagaaacatatatagcaattgggatgttgtttaccaagctaacaaattagcaagctaataagaaaaagagatacatttccacaggttttggtgccttagcaaaagtaggaaagagggatcttctgcagtttatgccattgcagcatgaatagagaactgtaaatctcctggatcatgggataccaagtctgggatgacacatgctttctctggtatacacgcagtgatgctggcagagtgtgttagatgagcctctccctgccatccctgcagcttgtgttctagcattggccaggtggattgagagtgtggcatttgtgaaacagtggtgcatgttcagtcaactgcaaacatgcgattcttcagtcagaaaaagtaagcctttatcgcaaacatgctgtggttgtaaaaatttatagcaacccacagtcaagttaggcaaaggaattggaagagtggactaagggagttcatctgatttttagatacatgcccagaaagttagagagagatgagttttagtagtcactgagtttgtacaagtttttttgatgtgtttttgttttgtttcatttttttttaaatatctgatcatgggtattattattattttgagatggagtctcgctctgtcgccaggctggagtgcagtggcacgaccttggcttactgcaacctccacctcctgggttcaagcaattctctgcttcagcctcccaagcagctgggcctataggcacgtgccactacacccagctaatttttgtatttttagtagaaacatggtttcaccatgttggccaggatggtctcgatttcttgacctcatgatccgcctgcctcggcctcccaaagtgctgggattacaggtgtgagccatcgcacctggctgatcatggttatatttcatagtgttattaaactttatcatttatgatgcttttggcctgttacccagtttaattctctttagaggatgtatagcctgctgcattgttcacatggtatgagggaacagatctgggaatcctccctgatgtagggacagttcgtcccaagcactgcccactttatgctttctcacaccacaggacactgactgtggtgtgaagggaccttacagcccagtcatattctgcctgcgtttggagtaatggtgatcatagccaacacaggtttggaagaaatgaatgaattcaaatgcagattgtgttaagtgtatgtgcatatatatgtgtgcacacatatacacatatgtacaaatgtacctacacagacatctatatatacatctatataccagttctattaccccactcatctcttcaacagtgtggcagtaaggagctctagacacaaatgatgagaaggaggtagaagtgctccagtgcccctgttagttttaattttaagacagatggatggacggatagatagatagatagatagatagatagatagatagatagatataggtatcttttatccatttattcagtatctactgaatttttgagggtctactacgcatggttcgaggttgaggatgaaataatattatggctgtggccttatctttttttttttgataaataaatttccttttccattttaaagcttttgtagataggtagcaggaagagaaacaaaggtgtgtccaggccctcagtatgtagtgtagatgaagattgtgtctagggaaacagtcaacattcattcctatcccttgttatctgtgtgatcttgggcgagtcacttaacctcttgaccacagttttttaatttgtttctggcagccagggaggtggcccatgcagatttttgttcctgaaagaacgtgccattcagctgtaaggaatgtagtgggcagacaagcctcctgctggcatgtcagcaccttcaggacaggactgttttgaagccaaagccatgctctccctgcagccccagccagtgactgagcacaaatgggtcacttctccttctctgctccctgctgcccccaaggaggctcttgctcttctacctccctctcatcatttgcatctagaggtccctactgccatactgttgaagagatgcgtagggtaatagatctggtacatggcgtatagatgtatatatagatatctgtgtatgtacatttgtacatatgtgtatatgtgtctatacatatatatgcacttaacataatctacatttgaattcactatttgtttttccacgacaaaattttcttactgagatttaagtaagatggaagtttgtccaccacatttataaggcccaaattacaaaacaataggattgcaaatggagtaaaaaccaaagtagagaaaacttattgggagtttctttggaggatgaagaaggggtgaatgagaggagagaggatgtgtagaaatgcctggtggggcttggagcagtggaagtggccacatggtagaaattctacttgtacacgtagctctgtggttaaaatcagtgaagggctgaatttgaaactttcattagtagcactaataagattttattggatttagaacatgctgagtattattgtagttttagaggacaattcatgactccatttgtcagcctggatttggggatctcaagtcagtttacgtaataggacatctctctctctctctgacttctgttccacttccttggtttccccacagatccacattctgactggttgtatgcaatggaggtcatggaatagcagccagaagtaaaacagaaaaataaccaagctcggttttattttaaactttgaatctgtgattgctgtgattaaaagaaaacgtacttgattatcttcaaagatcgttactgtaggcattacaggtcttcctcccaaactggtgtttgatgaaggagacgtgccttttccaaacctgattaaatacaagggggattttgtctatgtgcagaatttaaatgattctcataccgtaaaattcccacctttcccagcttatgaggtcgtggtaacgatagtgttaatgattgcaccgtttcactcacactttcaggagaatccatgtttccagcttgcatatgatatatcacagagaagggtaagggctaagcatcttagagagtagcagaaatcataatctagatagaactggatgaatctttaatgctacagagcataccttgagttttagaactgaaactcttgaaatagaacagtttctttggctctatcctggactactaccatactgtatgggtttatatctatctatctatctttggttctcaaaaaatagaaaaataaatgaagtcctttttagatgacaatccattaaagaatgaatcacattaattaaaatatgataatattaaaacctgataatctgacaatctaagttgtatttcactacagaaacagtatagaaaataaattctccattttcaggactaggactatgaaatctgaaattctggctgaacattttaagcatccttaattcattgattgccaagaagatattgaggtggaaatgataatatgaacaaaagaattaagatgcagtcatctttggttcacagtatagagttgaatataagttgttaactgtctgaaataatgttaactacttctatgatggatagtttcctttaaaaaattattattgatgtaagacttaaatggacttggtttgttattggatggagaagctggccttctgcattgagtatctcttagcaggaatgcattcctttagaccaatgtcttacacattggaggaaccagtttgtggatcctcaccaccgttttgtcatctgttctgtggaaaactttttaaaaaagccaattttcagacttgtcattccaattatatactcatcaacacttaagaaaaatattaaaaatctgtccagtatagcaacagatggtaatctttttatttccttttgaattaaaaaaaaatattattaatgtttattagtgttttttgctcagtaaacttttttttttttgccaattatccattaatttcttttcattatctcttgtgaaaaaaacagagctgaaatgtgtctctgtacccaatggaaaacaccctgactgctttatcaccttgctgtttaaaaacaaaagcaacttttcacaggccgacacctttattcaaggattataaaagacaacagagaaatcttttttgtcttgaaataggaaaacttgatcaaagaattaggtattgaagcctctctaggtagtgaatgtgtgaatgggtgagtgaatgaatccaacagcttgacctaagaatgaagcgtagcaggctctgaattttgtgctctctttgtttctctgcgcagaatttaagaagaggattacctcaggttccttacttcagtctctatggagaccaagaaggtgcttatgaacatccaggctccagccttttccctgagggtcctaatgactatgtcttcagtcatcttccactccactctcagcaacaagtgcgagcccctatccccatggtgcccgttggtgggatccagatggttcactccatgccgccagccctttccagtttacatccttcacccacattgcccctgccaatggagggctttgaggagaagaaaggcgcgtcaggggagtccttctccaaggacccctatgtgctttctaagcagcatgagaagcgaggtcctcacgctttgcagtcatctggtccgcctagcactccctcctctcctcggctgttgatgaaacagagcacttcggaagacagcctaaacgcaacagagcgggaacaggaggaaaatatacagacttgtacaaaagccattgcctctctccggattgccacggaagaggcagctctgctcgggccagatcagccagcgcgggtgcaggagccccaccagaaccccctgggaagtgcacatgttagcattagacactttagtagacctgagccaggtcagccctgtacctcagccacccaccctgacttgcatgatggtgaaaaggacaattttggtacatcacagactccattagctcactccacgttttacagcaagagttgtgtggatgacaagcagttggactttcacagcagcaaggaattatcttcaagcacagaggaaagcaaagatccttcatcagaaaagagtcagctacattgatctatgatgcatggagactttcatttccacattttcccatttttttgtttttgtttttctagaaatggaggtaatccagtttatagcatgcctgtcctaagttacagtagtttgctattatatatacttttgttatatcaaaagaattaggtaaattaacaagtcatcatgagcctgaccaaaacaaaatttgaaattaacctattgggtctggtacttttaaaattgtacagatgtttgtgccttttctttactttgcttatattcttataagcattttttagcagtaatttgtacatattttagaatttgtgtatctgctttgtaataaatgtaatttctttccttttttggacacttggatctaaatgatgtaaagcaaaacagcatcaatatatatgtgaggttgcactaaaacatatttttatatgattaaaactgaacagcttttatgtacagctctgattctgtaatactaatatttatttactttgtttcataaattgtacattttttcttaatgttgtggattgcttttctatgtgaagcatgggatttactgttgcgtaactagaacaaaaatgtacattgtaaacaagatatttaaactagagtatcttattctgcacttatgcattagttaaaaaaagataaaggatgtatcagtcagttcttaactcttgtatatttttttgtctcttgtttgctggattgactataacttaagtgctgattgtgattttaaaatgatagtaccgtaaagcattaaagtaaacaatgtgctattgtgagttttttcaaagctttataaatcagttataaataatattaaaagtatttggtcttatgtgaacatgttgatctatatactcatctaaaaatatgggaaaacattccaccccatgtaaatatgtacaagtgcatcactggtacaattttatgtaactcagttggacactaggttgccacagacctatgctaggtgtctttaaaaaattaaggtgacaaagcacatgggactgtgtagagcttggttatcggccggcccggtggcttggcaggcagtgctgtgcgctgctcatggagaagacctgggcttagcaatctccttagttcttgctacacaggatggtgactggaactaaggctacacagagggtcgcacttggactctgagggttgggtgtggaagggggaaaaggggatggagacctgctccccagctcttcctgtcagccggtttacatgggaacagggttaacatctgtgttaggggaggtcaccttaccctttttcataggggaagagtgtcacactcctggctatctcagggggaatggggaaaagaatctttcaagggcaaagaactcgtgggaggatgtctgttgtatgtaatactcacaatggcttttggttagtgttgaaggtgggaagagcatttgtaggtccagaagagtgaaagagagggaggggtgcagcaacatgtgcacaggcacgcacatgtgtgcacgcacacatacaatctgggttatctttgtgctatatagtggattataattctgtgaaaccaagtttgtatattgaattacattaaggagtgttctttaaaaagagaaataaatatacaattacatgcttgaggtgtctagttcttatgtgttgctttacattttaatttcccaattttgtttctaaagtaattttgatactagcaacataccatctgtgcttttaattgctaggctctgcccatcctgagtgtgaatgcttttaacaagtgagaagacagtcattggcttccatagattatctgattagaacagatagtggtcaccaaggtgtgggccctaggaatagacttatccaaacctcagcatgggcctgggcagcatacgttgcatctgaacagattcatgaataaagcaaattatcatttttcctctgcctctcttgcagtatgcatacttatctgaaattccactggggaaacctcttctttctttttgctaaggtggctgaagctaagaatcaactaaaatatatcagaagatacccacaaatcacagttcttttattagaatgagtagaatctttttaataataagagcagaagctcattaaaagtcaaaacctattagtattttcactataaaaatctcaaatttgtggatttacaatgtacctatttgcttttatgagccagactgtctttttaaactgtgttttacaaaggtgatttaaaggtcaacacagacactctaatatctgtctcttaccaagaagaatcttttgattatgtagggtgatttgtgtgtcatattcctcattgatgtgtgcgtgcgtgtgtgtgtgtgtgtgtgtgtgtgtgtgtgtgtgttggtgatcccaggccaaatcaaattactctgtttcctcctctacctaattcatcactcatttattcagtcattcattcattcataaaagttattgagtgccaactatgaactgggtacgatagtgggcatttatttttatttttatttatttatttatttatttatttatttatttatttatttgagagagagtcttactgcaggccaggctggagtgcagtggtgctatctcagctcactgcaacctccgcctcccaggttcaagtgattctcccatctcagcatcctgagtagctgggtctacacgtgcatgccaccatggctaatttttgcatttttagtagagacagggtttcaccatgttggccaggcttgtctcaaacacctggcctcaagtgatctgcctgcctcagtctcccaaagtgctggggttacaggtgtgaacctaatgctcccagcctggtggtgggcatttagaattaataaagagtatccgtgccaccaaggagctcaagtaaataggaaagacatatatgtaagtaaatgtggataatatgatgtttgagctaaaatagttgcacatttggttttataaccataaagggagagagaaatcatcctggagagagcaatcatcctgctgagaatgaagaaaagcttcatcacagaggtagccttagaacagatccttgaaacaataaattgactaattcattcaacgtagcttttcatcacctacattggagtactcttgtgtgtgctaggtgtccaatatggcacaaaacagataaagtccttgccttaatggagtttatattctagaggagagggcaatataaaaaattagtgggaaaacgcatattagatctgatctgagatgtgtaaagcaattaatgtgtaaaaagcaagatgtagctggcaccctaggtatgtggcaaggtagtacatggttaagctagaaacacatatcaaagtccaatttcctaatccagcctacaggtctggccctgtaagcaatggagaaccaaggaaggattgaagcaataaagtggccttgctaattgttgtcgttatcattattttgggaaaaataaaatactgtggcaccagcgaagataagggaaataaaagcagcaacaatccaaacaaatgatggagacctggagaaagaagggacagttttgcttaatgaagaggaatggctgatagctagactgatttggtgctgggatgaaagagatggagaagttaaagatgatgagtttttaacctggacaatagaatgagggtggcattattcagccacaaaagagagtggatttgtacagaatgctggtaaagagatgagctttccttagcagttctgaaggagttcaacctcaaacaagagaggccagagctggagactggtttgtcagttcttgtttttcatcatagctgagagcactgaattggatgaaattcctcagggtatataaaggggtagaagaggaagtttgagggtttccaaaggtagacaaagaacataggggcgagcaaaggtatacttcacaggacagcacatctcatctgctgagccttaatgatacaaaattgtttaatatttttgagaacttgattttcaatatattccccaagataatttctagaaaacaaaacttttagaacatcatattctgagaaaaaatcaactgcatttgtggaattatttactattagttactatttccttagtagcataatagtagcttcattattaaataataaattagaggttattaaattaacctgtcatttacaaatatcttttccaaaacctgtagtctagagaagttaggtgaagttttcaaggagaaataggtggttcattacagaatcaaggctaaaaatgagctcccacctctttgtccaggtttgcttaaagaacagtttctcattatttatgctcttctcacttagatcaagattacaatcacaataatgtactgtgaaagttgttgggttgaatgggctcagaatcatacaaaaacaacaaagcttatttctgccctggaaatggtctttattagtttaaaatatattactaaatatggtggcatcgactttgccacagtacagttttttttcccaggggcaatttgacattatacagagcatcagctcccattaatttccgagtgtagagaaacatatgcttacccagactttatatgcaacaataaaccagcttggctatgcagtagtactgaagaacagggaaagtggtggaaattattctacttggcaccgaacagtacctaaagagtaacaagaagaagacacaaactctattttctagaattctctagatggatcattttatgcatacatatccattgcttatcaacaactaaggccaccttcagaaatatacatttgacaggatgtattgacttgtgcctgtaattccagctacttgggaggctgatctaggaggattgcttgaagccaggatttcaagactagaaatacatgttggttatcaaaatgaatcatatcaacagattttctctccattcgctaagtgcctataaatgtatttcagattctgcagtagatccctgccatggatttttatttttttgagacagcatcttgctctgtttcctgggctggagtgcagtggcaccatctgcaacctctgcctccctgactcaaagagacactcccacctcagcctccataatagctgggaccacaggtgcccgccaccacgcccagctaattttttgtatttcttttgtagagatggggatctcaccatgttggccaggctggtctagaactcctgggctcaagtgatctgcctgccttggcctcccaaagtgctgggattacaggcgtgagcaccccgcccagcccctggcatgttttattcttcaagtagattccaagtgttgttacattgttgaaatacaagcagaatccatatagttcgatgtgaataaaatcttattttggcaaaattaaaataaaatgattaatgatcatacatttccttaatttattaaaaatcatattaataaaatatttttaaatgaaaacctttctattaaaaaatgccactgggcacggtggctattatttcctacaggttattgttgcagcatgtaggaaaaactacatacacacacattgtacatggtccagggatccaggccatttatggggacagcatccccatacaaaatctcttgtagctaataatgataagtattctctacaagccctgttttaagtgctttcatttattccctcatttaatagtcacaaaactgagtgaaataatttgcttaagttttcccagctagtaaatagaagaggcagttaggctctaaagcggtgccatccagtagaactttctgtaatgggaaaaatgtcccatatctacaccttccaatacaaaagcctatagctatacatgactggagcactgggaatgcggacagtgcaagtgagaaactggacttttaattttatttaattatatttaaattaaacttcacatgtgtctagtgcttcctgaattgactggccacctctgcaggctggacccttcccctgtgcacaggctgcaccacccacctctataagcactcatcatttgacagctattgaggttctatcacatgctagctcttttcttggtgctggagctataccaatgaacaacaaccaccaaaccacaccaaacccaaaaatctgctatcaaagaacttaggttcagtgcttatcactaaatatctagttaaggattttggtgatacaatcctattgactgcttctgtttccattgagttttggaccctggaactcactcaagcaataacagccaaagcacgcttttttgaagaagtaaacaagcatcctcctcctcctgccagaaatctgttaaaagcaaggatggagaatatatcccattctcaggactcatgtggggtctctcacttctgccttggtataaatgcatatgcccccttgtggcctaaggaaagagagatgcagctgggctccccaagggccctgactcccctactgcttctgcataggacatggagtctatgaagagagcgccctggctcctggaagccttgccttgcttttctactgaccacatgttattaagtaaatggaaggcagaaggaaggagtctgacatttcttctcccacagtgaagggtggaggaaggaaagaaacagaggggtttcctttctctagcccagcggccatcctgactgtgaagcaaggggtctgaggagaaaactgctccttgctgccgcgtatccatctaagtagccagactcatggaaaaccacactgcaaatgttgccctctttggagaaaacccactgtcaccaaggatctactgttttccccaaaacatagtctatgactctctgttatccccttggaatcagtgagatcataattcacgtgatattcaactgaaacaaactagacaaagagattaaataaagcaacttcatcttagctcaaaaattagaacaagcagcctttcccagagagaattaagcccatcagaaaatgatttgagtgactatttttctcaaatcttctaaggagattacgtaactagcaccatccttgtgtgtaggaaaaaagttaatttgttacacacaatgggtgtcttagggcattaggacttaatattcatatggaagcctgtttgacaagggatggactgtggtatatttcccaactcgtatcatgcctagtcacattgtcaaatctagtttaacagaaataatacattgagtaccacaggacagcatcaaatccccccaaattgtatcatgccagcaatattaaaatgccccaaatgtgaacactgcctcattaatattttccagaataaacttaaattgcaaaaagataacctccttttatattaaatactaaataaatttaagtccccagttttgcttcctttaattccttaccccaagaataacataacttacgttcccagggaaggttacaattcaaatgtgttaggcatttcagccaggaccttggtgtacctaccactcggcaatatgggatttctttcagggaaagtggtccacacaaggaacatagccagatgggaaaaaatgttatattccctatttatcatccctcctccctctgccaatcacatgcagcaaatgcttcaggttaatgatgcattcaagaatgtgtcttgatctccattctgaagtaaagccaccttctttctatgtaaatctaaatcttagggtatgtataactagacattcctatgtcaaaagagatatgtccagatttactgcattctgtttagataaataaatatgtgtcattttatgtatatatacattatttcatttactccttttagctcctgtaatatgggcattataacttccatttcgcaaatcaccaaatatttgtagagaaagaaacataaattttataacttgcccaagattacataactgagtttcaaactcaggtctgtctgactccagaatcatccattccattatttcattgattgtcattcagccatagctgcaagctttcaaaggaaattcatcatttgttctttcattcattcaaacatgttgattgactgactgctcctgctgcactgtttagtaagcaagaccgcatgtgagcaagagatttcaatgacagcatggaaaggaatttgagagagggattgctgcaatgcaaacccagatttgaggtaagtgaatctgaactataaggagggaaccctaatctgaacaaaaagtaagggtgttctggaacgtaaggtgattatcaggttagtgcagaacattaaaagtgttacaggtaggggaggccctctggaaaaatcccacagcaagagagagcaggacatgttggagagaacaaaacaaattctacagagggagtaaagattctgaggtgcagggccaggaaagggatagcaagaggtggagccgacgggataaacaatgatgagatactgcagggtcttggaaatcatttttagaggtttagacattagggcaacagttatttgggaattagagcgtgctaggtaggaaactgatgggacagggtttgcggtttacccgctaaaagggctttaaggtacactgtccaagagtcatagcaacatggggctacagagcacttggaacgtggttactccaaattgatatgcactgcaaatgtgaaatatatgccaattttgaagatatagcacaaggacggtttcaaatatgttattcataattgttcatagtgagaacatgtttaaatgatactacactacaaatattaggttaattaaaatgatgttaaaattaatttcctatgcttctttttttaggttggtaccagaaatttcacaattgcatacgtggctcacattgcatttctattggatggtgctggtgaaagagagaatagatgaggggttgggaggggccactgagttcagctaggcggctatttccatgatggtggcctgcaataatgcggcagtggtgaagatgaaagaaagcagacagacttgaactgcaagaaggtggtgcaccatatgagatggtggtttattagatacaaggttctcagaagaagggggcgtcatggttaacgtcccattcctagctagccacaaacagattaaagatgatgccttttcacaacatggttaaagggcagggggcagggaggtttgggagagccctgacggatttggtagctcttccttacttcctgactttgggggtcctgtggacatctgaaaggagaggtccagggagcaattggaactgtggttcttctgatactatcttaataataataaatctatctgtaatttatttaaagtggatcatatgccagacagatataatctcatttaatccttccatgaatttgttgataagaatatggctacattcccttccttttttattgctctatatcaatggttcacaattttatcaactatcatattttatagtgcctcttttgtatagtttactcatcctattatatggaaaatatccatataattttgaaattattatatggataattgaaattatccatataatgtataatatccatataatattttcaaaattatatggataatttcaaaaatttcagtataataccctaactatatataaaggagaaatgacagaaacttaatttacaataaaattttattcatctattaaataggtaaatgtactgtgttatagttaaagattacagtagaaagtataatgaagaagttaggagcttgcacctccatgcagatcaccgtgattatgacagctacatattcacctgccggtgtattatactgggaactcagatgccacaagtggcattgtcattagaacatgattttctgaaatgagaaagaaaatctcggaaagttccaaaaataacaaaatgtgaattttctcaattgacatgtggttgccctcccagaaatatgcaacaaacctgcacattgtgcacatgtgccctaaaacttaaagtataataataataaaattttaaaaaaagaaaaaaaaagaaattataaaaattttttaaaaaattcagtctccagtccattctgctgtaatgtttgttttaaaatttttccaacacagttgacatactagggaacaatttgaacataacacatttgcttatgcttgactttttaattgagaaatactaggtgaatgcagaagacagcacttagctgaaggagccatgtaggaatatacaaacataaacactaacacaattccaatgtctaccagctacctcatttcaccaagagtgttatgaccccacccatatacatagtgtacagcatagtgaagttggactttctgttcaatttcagatgaccttccttccatcacttcacagtaagtcacaaactgcagctcttctgtcacctacttctagtagcgaatattagatgtttttcaagttaagcgccgcatttattggagtacttatgtatttcttaaccattaatgcatgtaaaactatgctaccatttttactggcaccctatctttttttaacatatcactgatgaagttttggagtattgtgtccctaaccctgttttccccataagccctatggcttgttattgcacaattttgcatagtacaatgatttttgggagcacacttgtcttctggtagcagagatgacttgaaaatctatacccccacttcagatttgctttataatgaaacagagcttgattctaggctcacatgaatccaaatgagtatttcactttcgtgtcccatttagagtaacattcaagtttacaaaatggttctgctcattggtggaactccagtgttggagaatcttaatcactaaatgccggcagcaccctgtcatcatagcaccaatcaaaagcctccatgaatttccaaaatgccctggggtgtgtttgtgtgtgattgatactgccctggttgagaactgctgatctatttgaagctagaagttaataaagatgaatcgaaattcattaggcagaattatttattaatcctagaaaacttgtcctcaatatcatagaatcaaacattttgagtattatgtctaagaaactatttcaaagcatttgacagtttctataagcacattttgaatatagttgctgacacataaatatatctataatgtgttaagactattactatttaagtcaatttaaaaataatgatgtcaaaactgcttttgttactactgtgttgctgctaatactaagatgattgcattcaaatcaaagtcactcagacaccaggatcactcctatttctactacgctaccgtagcccatgtagtctcaccatgaccacgtttatttaattgtagtgacatagaggatctgaaaaatgcacaaacatgcaaaaattacttgacatacacatttaaggattttcaaattgacctataccaaatagattcataggagtaactgcatttcttcattcccttcataaaccgagctgaacactccagactgctctctatacaactgtgcacttttcctgttgccagttgaattgtgtgcagttgaattcaatcccataccaatgta

SEQ ID NO: 2027 - DNA, 8885 bp, Homo sapiens
atggacactggggacacagctctaggacaaaaagctacctcaaggtctggagaaactgataaagcatcaggtagatggagacaggaacaatcagctgttattaagatgagcacttttggcagtcatgaaggacagcggcaaccacaaatagagcctgagcaaatcggaaacacagcatcagcacaactgtttggttctgggaaactggcctcccctagtgaagtggtgcagcaagtcgcagagaagcaatatccaccgcatcgtccgagtccttactcatgccaacactcactctctttccctcagcactcattgccacagggggtcatgcacagcaccaagccacatcagagcctcgaaggtcctccgtggcttttccctggccctttgccatccgttgcctctgaggacttatttccttttcctatacatggccacagtggtggttatcctagaaaaaagatttcaagtctgaaccctgcttatagccaatactcccagaaaagtattgaacaggcagaagaggctcacaagaaagagcacaaacccaaaaagcctggcaagtacatttgcccttactgcagcagagcgtgtgccaaacctagtgtactgaaaaaacacatcaggtcccatactggggagcggccatatccatgtataccttgtggtttctctttcaagacaaagagcaatttgtacaagcacaggaagtcacatgcccatgcaattaaggcaggattagtacctttcacagagtcagctgtatctaaattggacctagaggctggttttattgatgtagaagcagaaatacattcagatggtgaacagagtacagacacagatgaggagagttctttatttgccgaggcttctgacaaaatgagtcctggtccacccatcccactggacattgccagcagaggcggctatcatgggtcattggaagaatcattgggaggtccaatgaaggtgccgattttgattatccctaaaagtgggattcctctccctaatgaaagctctcagtatattggccctgatatgctaccaaatccatctttaaatactaaggctgatgattcgcacacagtcaaacagaaacttgcactaagactgtcagagaaaaaaggacaagattctgagccatcgctcaaccttctgagcccgcacagtaaaggaagcactgattctggttacttttctcgctcagaaagtgctgagcagcaaataagccctcccaacacaaatgcaaagtcttatgaagaaatcatctttggaaaatactgtcggcttagtccgagaaatgcactcagtgttacaaccacaagtcaggagcgtgccgcaatgggtaggaagggcataatggaaccattacctcacgttaacaccaggttagatgtcaagatgtttgaagatcctgtttcacagctgatcccaagcaagggagatgtcgaccccagtcaaacgagcatgctgaaatccactaagttcaacagtgagtccagacaaccccagattattccatcatctatcaggaacgaaggaaaactttatccagcaaacttccaaggcagcaacccggttctcttagaagctcctgtagactcttcaccccttattagaagcaactcagtgccaacttcttcagcaactaatctaactattcctccttctttgagaggaagtcactcatttgatgaaaggatgactggttccgacgatgtattctatccagggaccgtgggcataccccctcagcgcatgctaagaagacaagcggcatttgagctgccttcggtacaggagggccacgtggaagtcgagcaccatggcaggatgttgaagggtatcagcagttcatccctgaaggaaaagaaattgtctcctggggacagggttgggtatgactatgatgtctgtcggaaaccctataagaagtgggaggactctgaaacaccaaagcaaaactacagggacatttcctgcttgagttctttaaagcatggtggagaatatttcatggatcccgtggtgccattgcagggagtaccaagcatgtttggaactacctgtgaaaacaggaaacgccggaaagagaagagcgtaggggatgaagaggacacgcccatgatctgcagcagcattgtaagcactcctgtgggcatcatggcttccgattatgaccccaaactgcagatgcaggaaggagtcaggagtggatttgccatggctggacacgaaaacctttctcatggtcacacggaacgctttgacccatgtcggccccaactgcagcctggaagtccatctcttgtgtcagaggagtcaccttcagccattgattcagacaagatgtcagacctagggggcaggaaacctcctggaaatgtgatttctgtgattcagcacaccaactcactgagccgacccaattcatttgaaaggtctgagtcagccgaacttgtggcttgcacacaggataaagccccttccccttcagagacttgtgacagtgagatttcagaagccccagtgagtcctgagtgggctccacctggggatggtgcagaaagtggggggaaaccctctccatctcagcaggtgcagcagcagtcctatcacacacagcccaggctagttcggcaacacaacatccaggttcctgagattcgagtgaccgaggagcctgataaacctgagaaggagaaggaagcccagagcaaagagccagagaagcctgtggaagaatttcagtggccccagagaagtgagaccctttcccagctccccgcggagaagttgccacccaaaaagaagcgtctgcgacttgcagatatggagcactcctcaggggagtccagctttgaatccacaggcacaggcctctcccgcagccccagccaagaaagcaacttgtcccacagctccagtttctccatgtcttttgaaagagaagaaaccagtaagctttctgcacttcctaagcaggatgagtttgggaagcattcagagtttctgactgtccctgctggttcatactcattgtctgtcccaggccatcaccaccagaaagagatgcgacgctgctcatcagagcagatgccttgtcctcacccagcggaagtcccagaagttcggagcaaatcatttgattatgggaatctgtcccatgctcctgtgtcgggagcagcagcctccacggtatcaccgtccagggagaggaagaaatgctttctggtgcggcaagcttccttcagtggctccccagaaatctcccagggcgaggttggcatggatcagagcgtgaagcaagagcagctggagcacctgcatgctggcctccggtccgggtggcaccatggcccgcctgctgtgctgcctcctcttcagcaagaggacccagggaagcaggtggcgggtccttgtcccccgctgagctcggggccactgcacctggcccagccacagatcatgcacatggacagtcaggaatctttgagaaatcccttgatccaaccaacatcctatatgacaagcaagcacttacctgaacagccacacttatttccacatcaagagacaattccattttctccaatccagaatgccttgtttcagtttcagtatcctacagtttgtatggttcatttaccagctcagcagcctccctggtggcaggcacatttcccacatccctttgctcagcaccctcagaagagctatggcaagccctcttttcagacagaaatccattcgagctatcccttagagcatgtggcagagcacactggaaagaaacctgctgagtatgcacacacgaaagagcagacctacccatgttattcaggagcatcagggctacacccaaagaaccttcttccaaagtttccatcagaccagagcagtaagtcaactgaaacgccctctgagcaggttcttcaagaagattttgcctcggcaaatgctgggtctttgcagtccctcccaggaacagtggttcctgttcggatccagacgcacgtaccatcctatggaagtgtcatgtacacaagcatttctcagatacttgggcagaatagccctgccattgtcatatgcaaagtcgatgagaatatgacccaaaggacactggtcaccaacgcagccatgcaagggataggattcaacattgcccaggtgctggggcagcatgcgggcttggagaagtaccccatttggaaagcacctcagactttgcccctcggcttagaatcctccatccccttgtgtttaccttccacctctgacagcgtggccaccctgggaggtagcaagcgaatgctttctccagccagtagcttggagctcttcatggaaaccaagcagcagaaaagggtcaaagaagaaaagatgtacggacagattgtggaggagcttagtgctgtggagctgaccaactcagacatcaaaaaggacctctcccgcccccagaaaccccagctggttcgacaaggatgtgcttctgagccaaaagatggcttgcagtcagggtcatcttccttctcctcgctgtcgccctcctcatctcaagactatccttctgttagcccgtcttccagggagccattcccgcccagcaaggagatgctttccggttcccgggcaccacttccggggcagaagtccagtgggccttctgaaagcaaagaatcttcagatgaattagatatcgatgagacggcatcggacatgagcatgagcccacagagttcttcattaccagcaggagatggtcagctggaagaggaagggaagggccacaagcggcctgttggcatgctggtccgcatggcctctgcccccagcgggaacgtggcagactcaactcttcttctcacggacatggcagatttccagcagattcttcagttccccagtctgcggacaacaactactgtgagttggtgcttcttgaattatacaaaacccaattatgtgcaacaggccaccttcaaatcctcggtttatgcttcatggtgcattagttcctgtaatccaaacccatcaggattgaacaccaagaccacgctggctcttctgaggtccaagcaaaaaatcactgcagaaatttatactctggctgctatgcataggcctggaaccggcaagcttacatcatcaagtgcttggaagcagtttactcagatgaaacctgatgcgtcctttttatttggcagcaaactagaaaggaaactagtgggaaatatcttaaaggaaagagggaaaggagatattcatggagataaagatattggatccaaacaaactgagccaatccgaattaaaatatttgaaggagggtacaaatcgaatgaagattatgtatatgtcagaggacgtggccggggaaagtacatttgtgaagaatgtgggattcgctgtaagaagccaagcatgctcaaaaaacacatccgtacccatactgatgttcggccttatgtatgcaagttatgtaactttgccttcaaaacgaaaggaaacctaacgaagcatatgaaatctaaagcacacatgaaaaaatgcctggaattgggagtctcaatgacatcggtggatgatacagaaactgaggaagcagaaaatttggaagatttgcacaaagcagcagagaagcatagcatgtccagcatttcaactgatcatcagttctccgatgctgaggaatcagatggtgaggatggagatgataatgatgatgatgatgaagatgaagatgactttgacgaccagggagatttaacaccaaaaacaagatcaagaagcaccagtcctcagcctcctagattctcctccttgcctgtgaatgttggcgccgtaccccacggggttccttcagatagttccctgggacattcttcgttgatcagctatttggttactttgccaagtattcgagttactcagcttatgacacccagtgattcatgtgaagatacccagatgacagaataccagaggctattccagagcaaaagtacggactcagaaccagacaaagacagattggacatacctagttgtatggatgaggagtgcatgctaccttcagagccaagctcctctcccagggacttctcaccctcaagccaccattcctctccaggatatgattcttcaccctgtcgagataattcaccaaagaggtatctgatacccaaaggagatttatctcccaggagacatttatcacctaggagagatctgtcacccatgagacatctttcaccaagaaaggaagctgcattgagaagagagatgtcccaaagagatgtttcaccaagaaggcatttgtctccaaggaggccagtgtctcctgggaaagatatcacagcaagaagagacctctctcctagaagagagagaagatacatgaccacaataagagcgccatctcccagaagggctttataccataacccaccattgtccatgggacagtatttgcaagcagagccaattgtattggggcctcctaatttaagaagaggattacctcaggttccttacttcagtctctatggagaccaagaaggtgcttatgaacatccaggctccagccttttccctgagggtcctaatgactatgtcttcagtcatcttccactccactctcagcaacaagtgcgagcccctatccccatggtgcccgttggtgggatccagatggttcactccatgccgccagccctttccagtttacatccttcacccacattgcccctgccaatggagggctttgaggagaagaaaggcgcgtcaggggagtccttctccaaggacccctatgtgctttctaagcagcatgagaagcgaggtcctcacgctttgcagtcatctggtccgcctagcactccctcctctcctcggctgttgatgaaacagagcacttcggaagacagcctaaacgcaacagagcgggaacaggaggaaaatatacagacttgtacaaaagccattgcctctctccggattgccacggaagaggcagctctgctcgggccagatcagccagcgcgggtgcaggagccccaccagaaccccctgggaagtgcacatgttagcattagacactttagtagacctgagccaggtcagccctgtacctcagccacccaccctgacttgcatgatggtgaaaaggacaattttggtacatcacagactccattagctcactccacgttttacagcaagagttgtgtggatgacaagcagttggactttcacagcagcaaggaattatcttcaagcacagaggaaagcaaagatccttcatcagaaaagagtcagctacattgatctatgatgcatggagactttcatttccacattttcccatttttttgtttttgtttttctagaaatggaggtaatccagtttatagcatgcctgtcctaagttacagtagtttgctattatatatacttttgttatatcaaaagaattaggtaaattaacaagtcatcatgagcctgaccaaaacaaaatttgaaattaacctattgggtctggtacttttaaaattgtacagatgtttgtgccttttctttactttgcttatattcttataagcattttttagcagtaatttgtacatattttagaatttgtgtatctgctttgtaataaatgtaatttctttccttttttggacacttggatctaaatgatgtaaagcaaaacagcatcaatatatatgtgaggttgcactaaaacatatttttatatgattaaaactgaacagcttttatgtacagctctgattctgtaatactaatatttatttactttgtttcataaattgtacattttttcttaatgttgtggattgcttttctatgtgaagcatgggatttactgttgcgtaactagaacaaaaatgtacattgtaaacaagatatttaaactagagtatcttattctgcacttatgcattagttaaaaaaagataaaggatgtatcagtcagttcttaactcttgtatatttttttgtctcttgtttgctggattgactataacttaagtgctgattgtgattttaaaatgatagtaccgtaaagcattaaagtaaacaatgtgctattgtgagttttttcaaagctttataaatcagttataaataatattaaaagtatttggtcttatgtgaacatgttgatctatatactcatctaaaaatatgggaaaacattccaccccatgtaaatatgtacaagtgcatcactggtacaattttatgtaactcagttggacactaggttgccacagacctatgctaggtgtctttaaaaaattaaggtgacaaagcacatgggactgtgtagagcttggttatcggccggcccggtggcttggcaggcagtgctgtgcgctgctcatggagaagacctgggcttagcaatctccttagttcttgctacacaggatggtgactggaactaaggctacacagagggtcgcacttggactctgagggttgggtgtggaagggggaaaaggggatggagacctgctccccagctcttcctgtcagccggtttacatgggaacagggttaacatctgtgttaggggaggtcaccttaccctttttcataggggaagagtgtcacactcctggctatctcagggggaatggggaaaagaatctttcaagggcaaagaactcgtgggaggatgtctgttgtatgtaatactcacaatggcttttggttagtgttgaaggtgggaagagcatttgtaggtccagaagagtgaaagagagggaggggtgcagcaacatgtgcacaggcacgcacatgtgtgcacgcacacatacaatctgggttatctttgtgctata

SEQ ID NO: 2028 - protein, 2446 aa, Homo sapiens
MDTGDTALGQKATSRSGETDKASGRWRQEQSAVIKMSTFGSHEGQRQPQIEPEQIGNTASAQLFGSGKLASPSEVVQQVAEKQYPPHRPSPYSCQHSLSFPQHSLPQGVMHSTKPHQSLEGPPWLFPGPLPSVASEDLFPFPIHGHSGGYPRKKISSLNPAYSQYSQKSIEQAEEAHKKEHKPKKPGKYICPYCSRACAKPSVLKKHIRSHTGERPYPCIPCGFSFKTKSNLYKHRKSHAHAIKAGLVPFTESAVSKLDLEAGFIDVEAEIHSDGEQSTDTDEESSLFAEASDKMSPGPPIPLDIASRGGYHGSLEESLGGPMKVPILIIPKSGIPLPNESSQYIGPDMLPNPSLNTKADDSHTVKQKLALRLSEKKGQDSEPSLNLLSPHSKGSTDSGYFSRSESAEQQISPPNTNAKSYEEIIFGKYCRLSPRNALSVTTTSQERAAMGRKGIMEPLPHVNTRLDVKMFEDPVSQLIPSKGDVDPSQTSMLKSTKFNSESRQPQIIPSSIRNEGKLYPANFQGSNPVLLEAPVDSSPLIRSNSVPTSSATNLTIPPSLRGSHSFDERMTGSDDVFYPGTVGIPPQRMLRRQAAFELPSVQEGHVEVEHHGRMLKGISSSSLKEKKLSPGDRVGYDYDVCRKPYKKWEDSETPKQNYRDISCLSSLKHGGEYFMDPVVPLQGVPSMFGTTCENRKRRKEKSVGDEEDTPMICSSIVSTPVGIMASDYDPKLQMQEGVRSGFAMAGHENLSHGHTERFDPCRPQLQPGSPSLVSEESPSAIDSDKMSDLGGRKPPGNVISVIQHTNSLSRPNSFERSESAELVACTQDKAPSPSETCDSEISEAPVSPEWAPPGDGAESGGKPSPSQQVQQQSYHTQPRLVRQHNIQVPEIRVTEEPDKPEKEKEAQSKEPEKPVEEFQWPQRSETLSQLPAEKLPPKKKRLRLADMEHSSGESSFESTGTGLSRSPSQESNLSHSSSFSMSFEREETSKLSALPKQDEFGKHSEFLTVPAGSYSLSVPGHHHQKEMRRCSSEQMPCPHPAEVPEVRSKSFDYGNLSHAPVSGAAASTVSPSRERKKCFLVRQASFSGSPEISQGEVGMDQSVKQEQLEHLHAGLRSGWHHGPPAVLPPLQQEDPGKQVAGPCPPLSSGPLHLAQPQIMHMDSQESLRNPLIQPTSYMTSKHLPEQPHLFPHQETIPFSPIQNALFQFQYPTVCMVHLPAQQPPWWQAHFPHPFAQHPQKSYGKPSFQTEIHSSYPLEHVAEHTGKKPAEYAHTKEQTYPCYSGASGLHPKNLLPKFPSDQSSKSTETPSEQVLQEDFASANAGSLQSLPGTVVPVRIQTHVPSYGSVMYTSISQILGQNSPAIVICKVDENMTQRTLVTNAAMQGIGFNIAQVLGQHAGLEKYPIWKAPQTLPLGLESSIPLCLPSTSDSVATLGGSKRMLSPASSLELFMETKQQKRVKEEKMYGQIVEELSAVELTNSDIKKDLSRPQKPQLVRQGCASEPKDGLQSGSSSFSSLSPSSSQDYPSVSPSSREPFPPSKEMLSGSRAPLPGQKSSGPSESKESSDELDIDETASDMSMSPQSSSLPAGDGQLEEEGKGHKRPVGMLVRMASAPSGNVADSTLLLTDMADFQQILQFPSLRTTTTVSWCFLNYTKPNYVQQATFKSSVYASWCISSCNPNPSGLNTKTTLALLRSKQKITAEIYTLAAMHRPGTGKLTSSSAWKQFTQMKPDASFLFGSKLERKLVGNILKERGKGDIHGDKDIGSKQTEPIRIKIFEGGYKSNEDYVYVRGRGRGKYICEECGIRCKKPSMLKKHIRTHTDVRPYVCKLCNFAFKTKGNLTKHMKSKAHMKKCLELGVSMTSVDDTETEEAENLEDLHKAAEKHSMSSISTDHQFSDAEESDGEDGDDNDDDDEDEDDFDDQGDLTPKTRSRSTSPQPPRFSSLPVNVGAVPHGVPSDSSLGHSSLISYLVTLPSIRVTQLMTPSDSCEDTQMTEYQRLFQSKSTDSEPDKDRLDIPSCMDEECMLPSEPSSSPRDFSPSSHHSSPGYDSSPCRDNSPKRYLIPKGDLSPRRHLSPRRDLSPMRHLSPRKEAALRREMSQRDVSPRRHLSPRRPVSPGKDITARRDLSPRRERRYMTTIRAPSPRRALYHNPPLSMGQYLQAEPIVLGPPNLRRGLPQVPYFSLYGDQEGAYEHPGSSLFPEGPNDYVFSHLPLHSQQQVRAPIPMVPVGGIQMVHSMPPALSSLHPSPTLPLPMEGFEEKKGASGESFSKDPYVLSKQHEKRGPHALQSSGPPSTPSSPRLLMKQSTSEDSLNATEREQEENIQTCTKAIASLRIATEEAALLGPDQPARVQEPHQNPLGSAHVSIRHFSRPEPGQPCTSATHPDLHDGEKDNFGTSQTPLAHSTFYSKSCVDDKQLDFHSSKELSSSTEESKDPSSEKSQLH

SEQ ID NO: 2029 - DNA, 95982 bp, Mus musculus
  misc_feature (1)...(95982): n = A,T,C or G
ctccctcctccctccccctctctttctttcagtgctgtatgtatgtatgtgtatgtatatgtatgtatgtatacatgtatgtgtgattatgtatgtatatatgcatgtgtgtatgtatgtgtatatgtatgcatatgtgtgtgtatgtatgtatgtatgtatgtatgtatgtatgtatgtatgtgtttttacatcccaattggtctcccactcctattcccccctttatatagtatccccctatctaccttctcctctgagagggtggggccaccctgagtactctcccagcctggcacatcaagtctctgcaaggttaggcaaatcctcttccactgagtccagacaaggcagccctgttgggaagagattctacacacagacaatagctttagggacagccacgttcttcgtcttgtggagccattgctggacagtatttcatgggaaggacatgtttcagaaggtctggtaaatatccaggataatcaagcacactgttcagggttacagattataaagttgagtataccgtatttatagtttgtgttccagacaggcttgagagagcactacaaactaaattatacaactttcaaaataactgcttctcttttctggaactttaatatagcttgcatattttctaccaacaaatactttcaatcaagtattttattattattattttttatgtaggaatgagcgtagtagtttcaaaatgtctccatgcatactcttcttagcagatgaataacatactcctaatatttaaagtgctataggatttcttcacagttggttcttgaggtgttgatgttgttgttgttatttggtccagggtttgagacctctgctgaatagaaagtcaagatggtataatttaaataccacttttcttccctgaagcgctgcctctgctcatcttgtggcttttgagtatttaaaaagtagttaaatattaaaaggcaaaggaagagaaaagaataagtgcctctcaatgacttagggtaacaaaactaaacaaacttccccatgcaagcgaagttctgcgtgtggggtgggagtggggacagcacagatcagagcagaagctcggaaagggaatgagactgctcccggactgaactctgtccagcacagtcaatggctggctcttgttttctcatttttaaaagtgaagtattccacgaggaatcatttatttaaagtgtggtgatctatggttcacattagctaattccccgtttgtccttggggcctttctttcccctcctttattctgtctttgcctccctccctccttccatcccttttttcctccctccctccctccctccctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggataaggttctgactttgtagccccgcctacttggccctcgttttatagccatctttcatccctaggtcagtgagtgttgagaatagaagccttgcatacccctgctcctttgttaaggtcaagagttcacggaaaaataacagaagacttcacgggccctgcacttatggacttcttagagtaacagtgaaattccctaaaacattttttttttcactttaaagaggaagggcctgtagtgtaaacagtggagtgagtcacttaaattcacaaagccagtaacacaaaacgcaatagtgtcaaagcacatctctgattatcatactggatctacctcatagggtttttttttttaactttttgaatatttttcctattattagaaacccatcggtatctaatttaaattaatttaaatgctagttcttacactttctgttcaaacatatttgttccggtaggaagtccaactgaaagttaaatttatgaacacttctagaaatttcttcaaaatttcacaacagggagtatcatacaggaagttagaacgatgttccccacaaatcagcacagcgtctatttgcatctgtctcttgtgcaatcctggcaattttccgctagcttggatgtcccttcaaggccctcccgtgtaaggaccagctcgcaaaggacagcggcagctccttttacagaagtgtagaagtggcatgaagttgcaaattttgcatggcttggaggacagagctgttcatctgctaataactctcttctccactgtattcccagaaggtaccttattctaagatgaggtctaccccaaacacacttgggaggcagggaaaggaaatcctgtactaggacttctttgggcaacttctgtttacactgtaggctaagactttcatgtgaaggacctgttagagattataaatactgtttagttcttagatgcctgtagatcctctagctaggcacctcagccctcacccaccccacataatctttctcctatgttaaacaaaaccaacccaacccaaaccaacccaacccaacccaacccaacccaacccaacccaacccaaaccaaaccaaacaaaaccaaacaaaaccaaacaaggcaaaacaaaacaagtgaatgttagttgtagttctatgacacacattaaccggtcccaccatgtgtagtttgggttgattaaatatattccttgtacacacaaagacactgagatgtgtaaagcatccctagagatgaagtgctcaccttctaggagggggattccactgtatcccaagcccagtcattcacagcactgaacttcacaagctgagaaaatgtgtctttctccttgggtcctccacagattgggagctgaataaataaataaaagttgtgataaatggctgaatatgcatatgagagctatgttttaactaatcaatctattctattacgtattcctgcaatggcattctcttgctgtgcttggccgtattttcagtgatgatctagacttagtttaattccattttctatcattaaatgataattatataattataatcatgtttgaatgtctatcaatgtgataattttccatccaactaaaattatttttttaatcaatattattttgcatatataaataactttcaaaatgtctttggggtcggatataattctatgaaacggtgaaacaaacctctggaagatgcctgttttcatgcatttgcattaaatgattctggttgtaaactttcatttcattactgtctactgggttattaaatgttagcagattattctaagattacaaattaatttttagagtatgttttaggttacaaataaagacgttgtctggaaaaaatggagattttaatttgggggtcaataatttaacaattaaatattctttcatttggtttttaccgtgaaaacaacatctgtgtttgcagtcccttggtaggaataagtcagcagtaagctgaggtcttccggcctgtttaacacagactgatttaattattgaaatctgcactcaaaaggcactaagcattatagaattttccctgtcacaaagaataattcatcatcattgtagcaaattcaaaacatgaagaaaaaacaaactttctgaaatggtgtttaggaaaaaaaaactcatactaactttttttagtttttatataaattacattattattttcacttaatatttactgagcataaaatactttataaagctctgtgaattgctagagttttaataattatgcaaagagtcataagaataggcaatgcagagaaacctgtcaatgcctattgacaatgtcaagtccattagaattgtcatacaagtccacatacatgcctgaggttttagttcatagtttgcatcacaggtgcattcaacaaagagccaaaccataggtttaataaaatacaaccagtattttgttctgatgaagaaattatataaggtaactttcaggtaattgagattttctatactatagattctctatggcatagagattttctatagtatacaggttatctatagattatcgatagtatgtagataaaccaaagcatacagattctctgtactatatagattcactatagtgtatacactatataaattctctaaaatgtatctatgatatatatatttgctataatatatagattctctaaagtatatgggttctttatagattttgtatagactatggtatataggttctctatagattctgtataatttatagattatatattctgattttccttggtaacactgtttaaacatgatgttttagagaggagcatgtttataaatcaggaattaaaataagacaaagaataaagagatcacttttagcttgttcaaagattgccacattaatttctgaacttggttcattaagcagtgaagacagcgtggtacagacagttcagtggtatgtatcagtgagtctcacaagcctacgtttaccactgacacaggaatgcataaaatcaaaagagatttgaaagcccatccagcacatggaaatagttatgatgcatatatcttcctatgtaaaactatgcaaatttaaatatctgcttgtatattcatcacgatgagcctatgaacctatgactattcctctctctgacttactctcgctactgaagaactgtttttaattaacaaataaagtactaatttggttagtcttaatttgaaaatcaatacttgatctctagttattgtgctcattttgaaaaaaaaaagtcttttttttttctttccattttttattaggtatttagctcatttacatttccaatgctataccaaaagtcccccatacccacccactcccactcccctacccacccactccccctttttggccctggcgttcccctgttctggggcatataaagtttgtgtgtccaatgggcctctctttccagtgatggccgactaggccatcttttgatacatatgcagctagagtcaaaagctccggggtactggttagttcataatgttgatccacctatagggttgcagttccctttagctccttgggtactttctctagctcctccattgggagccctgtgatccatccattagctgactgtgggcatccacttctgtgtttgctaggccccggcatagtctcacaagagacagctacatctgggtcctttcgataaaatcttgctagtgtatgcaatggtgtcagcgtttggatgctgattatggggtggatccctggataaggcagtctctacatggtccatcctttcatctcagctccaannnnnnnnnnnnnnnnnnnntcctttcatctcagctccaaactttgtctctgtaactccttccaagggtgttttgttcccacttctaaggaggggcatagtgtccacacttcagtcttcatttttcttgagtttcatgtgtttaggaaattgtatcttatatcttgggtatcctaggttttgggctaatatccacttatcagtgagtacatattgtgtgagttcctttgtgaatgtgttacctcactcaggatgatgccctccaggtccatccatttggctaggaatttcataaattcattctttttaatagctgagtagtactccattgtgtagatgtaccacattttctgtatccattcttctgttgaggggcatctgggttctttccagcttctggctattataaataaggctgctatgaacagcatgtgtccttcttaccagttggggcatcttctggatatatgcccaggagaggtattgctggatcctccggtagttctatgtccaattttctgaggaaccgccagacggatttccagagtggttgtacaagcctgcaatcccaccaacaatggaggagtgttcctctttctccacatccttgccagcatctgctgtcacctgaatttttgatcttagacattctgactggtgtgaggtggaatctcagggttgttttgatttgcatttccctgatgattaaggatgttgaacattttttcaggtgcttctctgccattcggtattcctcaggtgagaattctttgttcagttctgagccccattttttaatggggttgtttgattttctgaagtccaccttcttgagttctttatatatgttggatattagtcccctatctgatttaggataggtaaagatcctttcccaatctgttggtggtctctttgtcttattgacagtgtcttttgccttgcagaaactttggagtttcattaggtcccatttgtcaattctcaatcttacagcacaagccattgctgttcggttcaggaatttttcccctgtgcccatatcttcaaggcttttccccactttctcctctataagtttcagtgtctctggttttatgtgaagttctttgatccatttagatttgaccttagtacaaggagataagtatggatcgattcgcattcttctacatgataacaaccagttgtgccagcaccatttgttgaaaatgctgtctttcttccactggatggttttagctcccttgtcgaagatcaagtgaccataggtgtgtgggttcatttctgggtcttcaattctattccattggtctacttgtctgtctctataccagtaccatgcagtttttaccacaattgctctgtagtaaagctttaggtcaggcatggtgattccaccagaggttcttttatccttgagaagagtttttgctatcctaggttttttgttattccagatgaatttgcaaattgctccttctaattcgttgaagaattgagttggaattttgatagggattgcattgaatctgtagattgcttttggcaagatagccatttttacaatattgatcctgcaatccatgagcatgggagatctttccatcttctgagatcttctttaatttctttcttcagagacttgaagtttttatcatacagatctttcacttccttagttagagtcacgccgagatattttatattatttgtgactattgagaagggtgttgtttccctaatttctttctcagcctgtttattctttgtgtagagaaaggccattgacttgtttgagttaattttatatccagctacttcaccgaagctgtttatcaggtttaggagttctctggtggaatttttagggtcacttatatatactatcatatcatctgcaaaaagtgatattttgacttcctcctttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtatgggccttgaattcctgatctttccagaacttttatcatgaatgggtgttggatcttgtcaaatgctttttctgcatccaacgagatgatcatgtggtttttgtctttgagtttgtttatatagtggattacattgatggattttcgtatattaaaccatccctgcatccctggaataaaacctacttggtcaggatggatgattgctttaatgtgttcttggattcggttagcgagaattttattgaggatttttgcatcgatattcataagagaaattggtctgaagttctctatctttgttggatctttctgtggtttaggtatcagagtaatagtggcttcataaaatgagttgggtagagtactttctacttctatcttgtgaaaaagtttgtgcagaactggaattagatcttctttgaaggtctgatagaactctgcactaaacctgtctggtcctgggctttttttggctgggagactatttataactgcttctatttctttaggggatatgggactgtttagaaggtcaacttgatcctgattcaactttggtaccttgtatctgtccagaaatttgtccatttcgtccaggttttccagttttgttgagtatagccttttgtagaaggatctgatggtgttttggatttcttcaggatctgttgttatgtctcccttttcagttctgattttgttaattagggttttgtctctgtgccctctagtgagtctagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttcctttttttctagagcttttagatgtgttgtcaagctgctagtatgtgctctctcccgtttcttcatggatgcactcagagctatgagtttccctcttagaaatgctttcattgtgtcccaaaggtttgggtacgttgtggcttcattttcattaaactctaaaaagtctttaatttctttctttattccttccttgaccaaggtatcattgagaagagtgttgttcagtttccacgtgagtgttggctttctgttattttttttgttattaaagatcagccttagtgcatggtgatctgatgggatacatggtacaatttcaatatttttgaatctgttgaggcctgttttgtgacctattatgtggtcaattttggagaaggtaccatgaggtgctgagaagaaggtatatccttttgttttaggataaaatgttctgtagatatctgtcaggtccatttgtttcataacttctgttagtttcactgtgtccctgtttagtttctgtttccatgatctgtccattggtgaaagtggtgtgttgaagtctcccactattattgtgtgaggtgcaatgtgtgctttgagctttactaaagtttctttaatgaatgtggctgcccttgtatttggcgcatagatattcagaattgagagttcctcttggaggattttacctttgatgagaacaaagtgcccctccttgtcttttttgatgactttgggttggaagtcaatcttatcagatattaggatggctactccagcttgtttcttcataccatttgcttggaaaattgttttccagccttttattctgaggtagtgtctatctttttctctgagatgtgtctcctgcaaactgcaaaatgttgggtcttgtttgtgtagccagtttgttagtctatgtcttttcattggggaattgagaccattgatattaaggaaaagtaattgttgcttcctgttatttttgttgttaaagttggcattctgttcttgtggctgtcttcttttaggtttgttgagggattaccttcttgttttttctagggcattgttcccgttcttgtattggtttttttctgttattaacctttgaagggctggattcgtggagagataatgtgtgaatttggttttgtcgtggaatactttggtttctccatctatggtaattgagagtttggctgggtatagtagcctgggctggaatttgtgttctcttagtgtctgtataacatctgtccaggctcttctggctttcatagtctctggtgaaaaatctggtgtaattctgataggcttgcctttgtatgttacttgacctttttcccttaccgcttttagtattctatctttatttagtgcatttgttgttctgattattatgtgtcgggaggaatttcttttctggtccagtctatttggagttctgtaggcttcttgtatgttcataggtatctctttctttatatttgggaagttttcttcaataattttgttgaagatgtttgctggtcctttgagttgaaaatcttcattctcatctactcctattatccgtaggtttggtcttctcattgtgtcctggatttcctggatattttgagttaggatctttttgcattttccattttctttgattgttgtgccgatgttctctatggaatcttctgcacctgagattctctcttccatctcttgtattctgttgctgatgctcaaatctatggttccagatttctttcctagggtttctatctccagtgttgcctcactttgagttttctttattgtgtctacttccctttttaggtctagtatggttttgttcatttccatcacctgtttgtatgttttttcctctttttctgtaaggacttctacctgtttgattgtgttttcctgtttttctttaaggacttgtaactctttagcagtgttctcctgtatttctttaagtgatttattaaagtccttcttgatgtcctctaccatcatcatgagatatgcttttaaatctaggtctaggttttcgggtgtgttggggtgccctggactgggcgaagtgggagtgctgggttctgatgatggtgagtggtcttggttcctgttagtaggattcctacgtttacctttcgccatctggtaatctctggagttagtagttatagttgactctgtttagagattgttcttctggtgattctgttaccgtctctcagcagacctgggagacagattctctcctctgagtttcagtgctcagagcactctctgctggcaagctctcttacagggaaggtgcgcagatatcttgtttttggacctcctcatggtcgaagaagaaggcccaaaacagggcctctctcagaagctgtgttgctttggcagttcccagaagctgttagcttctgtggtgcagactctcacctgtgcagactaaaatccttaagttccagggagtcctggaaccaagatggtgaccgctgctcccaaggctgaggccgtctcccgagccaggcggacacctgtcctctggtccggatggtggccggttgtctgcggcccgcccaggctgctgcctcagcggctctgtgcttccgcccgtcccagaagctgtccggttctctggcacaccctctaacctcgaaaaagaaaagtcttataagaacattaaactaaaactcaaaattctcgattatcaccttggttctattgttaacaaagcagctttctttggttaagtcacttagggttttccctttgtttaaaaataagatggctgactatatgtctaataatatctaacaaagttcataaaatgtgatcatatgactaactcagttcaataattcactgataccaatttctaatatttatcctaaaatcttgttatacaaagtataaggaaatgaaatatacttaaattagcattcccaataatctttttgcaatacataaaaatgtatgagcaaaatgagctaaaagattttaacatctatacttttaaatacatatatatatatgaagaaagccatattacatactaaatatgtacatatgaagaacatatttaaaatcacatataattaacatgtggatggagatttgaagctatcaaagaggactctaccttacaaagaaagacagcagtgaaagaaatccaattcgagacatgactggtagatatttttcatgagagaaagccaagctagtctgcagtggtgaagatggtgacaagggaatagtttcaagaagagactcaagttggaggtgagatagactgtgctctggttcatgaactgttcagttaggttgatgaagatagtattcagtgaggtaaggaagactggatgagcatcctcttgggaaaaggctaccagcagatcttaaccatcttcataaatcattttaaaaagcctgtctgctattggaatcttggagaaagatacaagttgtaggtttttgtcatttaggtgatggtagcaagcatgggtctgggtgtatacatgcgagtgcacattaaaaaaaaaaaaaaaaaaaaaaaaaaggatgatgttagcagaggctctagagatggtcccaaagggatttaagcatttaatcccaggaaaagcaagttgccaacctataaaagttagaaatggaagatctataaaaagaagagaactagtggagtgtagaaaaaagtattttctgaaggcctatgccaaacattttgaaacatcaaggagctgaggagcttagaaaaaaatatgtatattagtgtgtatacacacacacatatgcacacgcatatacataatttttatgtatatacatgatttacatttttatttgtatttatatattataaatatattgctacaaataaatcccatctaatatagtcattcctataaatgttacttggaaaaagtggtcaaaaccaatgggataacaattgagatcccagtatatttcagtgttactggggaagttcataaaaagaagagagccaaaattcaaggaagagtaaaactatataaatcacgttgtgactctcccctttgagtcctaatactcttcaatgtgctttacaaagatctccctgaaagaccccatccatctctggggtcttccttctttctcttctggggagcacacaagagttttctcgggatcctagctttagaacggtgtaattttcttccttctgctctttgccttgctggcccatttcagttattcaaatcttcatccatgggtccttcatgatcatatgctgcctccaaaactgtatgtatcgtcacatgctggccattttccctcttcctattctgtgccatcattaattttgactgtaaacaaactaaaatcacctgggtagtgtgtcttaatgatcaggtttgtctgtgagcattttggaaagactgccttgattgttgtaggaggaaccagctcactgtggatagcaacattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatcagcgcacttgtcacagtaacagaaatgagattaagacaaggccttcattttagtatttacagagaagactatgctaaatacgtagtttaaattaatgaacccctttctctggtctcacatatgcagcctcttaactcctaacagaggacttaaaccacattttcttatttatatatttttctacaggattatgtagaatacaaattgtctgaaagcagtgaccttgttttcttattcaatgtcatacttccaaaatgtgaagagagtgcctaccttacgtaggtgttggataaagatttattgcttgactaaatatcattaagttgattctaaggggtggtcttaaggggcatatgattttaaattttgattacaattattatatacctaaagggaacagattaagagataaagatgaataagattattttaaatatttttttataaaatttatttttaatagatactttagtatttaaaaaaaacttcttatggtaatattaacttatgctacttaataacagtagtccagaaattatctggttccaattaaaaattcactaagaataatctatttattaggaaaatatatacaacaaatatttactaagtgtctactaccatgctaaatatagagagctaaaattaaatgtggtagactggaaagtggtaattcaaagatgagttagtgaacaaaaaaatataaaaaaaaatcataccagtgtgctttaaaagggctattacagtgtgggaaggaaagaataaaaggtcagattgttgtctaacctctgggccataaaatctttcttctcagaatttagacactttccaatgcttctcttcagcctagggacaaatcattaacatgaaattcaccctccctgctatataacacccccccccaattaaataaaagcccttcttacaaagtagggaaaaggagagtactgagccaaaggtgggagccaatcactgctctgtgccacaggtaagctctggctgcaggagaatgttgccatatgaaaagaactacagaaaagaaagagactgtgcagtgtggactttctgttcctggaaggggctaaagatgagaaaatagctctttcagaattggaagagctctataaagcaaagctacccagaaagcacagggtagggattcaggagaaaataatacccaaaataaatagcaatggaaattgggttgaaccaaacatgacctttggaaagagagggaggatttttgcatatctaagaatattgcatcacggtgctctttgaaagattcaagctatttcaatatttttccatttagttaatgcaggcagtatggcgcacactgacaaaatgtcacatttattccttaggtgctattatacacagagggagcatggggctcctatcggttgttcaaagtcattcttaaagagcaaaataaagtcttattataaatattgaaaatgtctgtatgcctgacagcttttactgtcgaatacttcttggagcacacagtgtcttgggaaggaacagcaagcatctgaggtgccacgggcacacagtgatgaggaagccaacacgtcacagtttacaaactgcaatatctatttagctgccgtgggtcagctaattaatcaaaagaatgagatggaaatgggaaagtatttttcagtccagagatttctgtaaataaaataaactgtcagccatccactcatctatctatctatctatctatctatcaatctatctatctatctatctatctatctatctatctatctatctatctatctatctatatatctatatatctacctatcttatctatctaaatatatcctcacatatgttaatgtaacaaaatacttacaaatacaaattaatataaaacttaccacatgaattattaaatccccccccccaaagcatagcataaataaaaattcactgacattatgctagtggtgattactattttttctttcaaaaaaacccccagaagtccttggtgcaaagcaggtaagatggctcaggaggtaaataacttgccagcaagtcggaccatccaagtttaatctcatgttgggagaagaggactcactcctgtaggatgtcctgtgaccaggacagccactctgtggcattcacaggacattgtctcctacatacataaaacaaataaatataacaatatcttaaaatgttgctcataccatgttaattctttttatccatactttgacataataagtgattctgatatattagaacatgatatggtgtgttgtaactatattttgtcttattcaatgtatatgtttttgaaaacaaaggccatttaatgaaatgtgtatttgaaaacatttcataattgaattgtagttcctccagaaattcatcccttccttcattcacttactaatccatccatccatccatccatccatccatccatgtttgagagactcactatttcaccctggctagccttgaactctgttagagcagactgccagaaattcacagagatcagtatcctttgttttagtattaaagaccttacctaacagagctagctctatagtcatctctaaaaggaaagtagagacatcttttctttcattcccagagtgtactctttctctttccttgtgttctattttcttctaatacttgctggtagcagtgtcaagcctgataacccaacaatctttttctgtgaaagacttagttattccttcccaacatctcatactagggaagactgagccattttatagattgctctgggttcatcccattttgttgtatttccaggtaaaaagatacattgctaaacctgctctgctttggtataaataactagatgtagcttattttataattttgaattccccaacatatggtggactttcaagttattgcttaaattgtcccaggcttccgcttttaagaccacattattaatttcctcacatttatgatcttgacatattttatatttaatcttttatgaagaataatttgactctgtcttgctctgtgtttgtgctaggccataaaatcaggtggtgacccagtgggatcaatgagaacattaaatcgactgcagaaatggctgtggatcagaaaagccagggtgccgagcctgcaagaggtgaagcctgtgttaatagacccccgtgagtaatccccttacttccaaagtctctgaggaaggactagccactcttgtatagtgacgtctgttctgatatggtcttaacggaatcattgacctttgagccttttctgtattgttatttgagaacagagattctagctgcaattcctgaatttccccccatccccccctttcctcatctggaagtccaggaagcaggtgagagtgctatggctgaagcttggaacagtatggttggctgggtctgtgctcccatttccaggccatagaaaacagtatttgtagtttttctatgtgagtaaagaaaggtgcactgtctatgccacacaactctcatttgcaattgtttatttacacaactctgtgaacaacttttctttgtttgcttgtccaactttgacttgtaccaggtgagattcgacacatagagctactcccctggggtgattcacattgttgtacctgtaattagttatgtgtggcaggagcttcttcttccgttactgttctgtttcccacagcttcagctggacacaatcaactcagggcagaaaatatgaagggaaaattcccagaaataaacaatttatagatgttgaagtctgatgatgtcctggtccttctagccagggatttagacgtccaaatagcaaaccattcctttatccagtatatatgctttataggttatatgtaccatcagagagggagggagagagagagagagagagagagagagagagagagagagagagagagagagagaggtgtaacttttcatgcagtatattaacagtgtattgcattaatattgttactctccatgtttatttcagaagttaaactttaaaaatcttaatctatacaggattcatagtattcggtttcatgcacaggttctaggagcagtcctccacggacactagtcatttcattaaacgggctgccatgccgtacacattgataacttactagtgtactttatgattatgctgaagatgttataccttcttccactttcttgcatttttttccttggaaaatatatgagatctatactatgcaaaaatatctctggagaataatattaaaatagaaaaatctgaatgcaaatattatttcagtcccatcctctgagatttcagctttttaagagaggcaaatgatttaattttcttccatatgatgatttcttatacatatggtctcaaaaattaaaatatttatgaatagaaacactccaagttatgcttataagatgtgaggatgtttttcaatttgcagttttccctcaagtgtctttcaacataccgtctgcctggaagtctattcatttcaatctaattaatggtaatcaacagatatcattttgaaaagtttaagtaaaaattgactttcatcaaacaatttcgtataccaaatgtacttgcttttttttaaagatatatgattttaagttgctttgtgaaactgactgacttcctggcttatcctgtgctgttccttcatttctattaaacaagagaaagcatagcatatacactttctctgtgtgaggaagcattagtcttgattattttagctcatggtttttgttgttgttgttgttgtttgttttttgttttttatcattcagaaggtggtgaggacacattgctttcttgtgtgaaattaaccaaatcccaaggaaagaaagatattgacatggccaccaagaaaagcaaaatcccgaatgctggaccacaatccctttctgcatccctcagtggaactagcgtttcaaatgcacacaacccggaagacccagtatctccttatgagattgaagttccagtgtgggggaacttgaaaccgttcccagaaaacccattctgggcaagcactgattttccaattggccaaggaggatactggggcagctgttcctcttgtcagcatcttcgtctcaaagcttcttacacagacatggatctcttaagtacatgggtaagtttttaagccatataagtacatcatcttaacttgaagctttgtaccaacacgaaaaaaccagtaacaagtgtgttaatcagagtgaggaaaatcaccagtgttacattgaccttccaaagatcagagatgctcccagtacttgttaatgctgtatatgttctctctctctccctggcaatttatatatgtgtgtgtgtgtgtgtgtgtgtgtgtgtgtgtgtgagagcgcatatgagcacccctgatagccacaggaagagatgagaactgaggaacacagatgaccttctcagctcgactgtaagttagcagatggtaccagaccaggcaccaggcctgtgacaacaactaaaaatgggcccaggcccacacccacaggcatgtcagagaagtaacaggacataggagaatgttgccaccagtgacaaggtgacatttttaactgcatgaaagttggcacaattgcatgcttgctggcttgcttgcttgttcagtgcaatgcagtgcagggaagtggttcctagtccccgagcatgccaaataagaactctccacagagaaacatccctgagccctcaaaggacagttttgaaagagactttaaaaagtcttgtttccatttgcctaggaatttcataaattcattgttttaatagctgagtagcactccattgtgtaaatgtaccacattttctgtatccatttctctgttgagggacatctgggttctttccagcttctggttattataaataagactgctatgaannnnnnnnnnnnnnnnnnnntctttgttttgtgtaaattactgctgttttagtaagatttcactgtctgacaaccgcaaaaacgaagtagtgggcctgccgttgtcaagagcctttcacatgaggtaaataatctcaatcacatagtaactatagactaagggtttattgtagtatcacgctactaatatctcccaatgccttcacaagtatagaaactacagcacagacgttttagggaaagccagaagccaaacagggaaagaatatgagtccatatctggaattcacatgatcatatgttggagattctctttttatctaatattttattgtattttcccacacactaggattgtggactacatgagaaagaatataactttataaacagacaaatttgatttggtttctagctttgctacttttttaagcttagccaaattactcaaaccatttaatcttaaatttttttactgtgaaatgaaaatagtaatattaaatgcacaaggtaccctgagaagccaaaattaaatatcataaatcatccaggacttaacgacattttatcttggttctaagttccttccttaggtgtacactgtaccttaattttctttgagttaacaattcagtttatttgtgcaggattaatggggtgctgtgtgtacccaggaagcctgttctatgccattttctctaaagattaatctctcattagatagcagctgtactttataatacattaaaggtttctgaaaagtctcattttttttgaaactcttgccatgttgtaagatttgctcattagatctcggaaggttgaggctggagagaggacccagaagtaaagaacttgcagaattctgggatcggtaacaagtcttacctccagcaaacacattagatagcttacaattgcttgtaagtccagctccagagaaatgtatgccttcaggcctcccctgaattctgcactccagtgcacgtactcacacacagacagccatgcataaacctaactaagcacaagcataagtattaactgtgtctctgaggacggatgctaagatcatgtgtgagtagagaaccatgatctctctctctctctccttttctttctctctcatttatttatcatttctatctatccatctctatctatatatctatatctatcatttctatacctatctatctatctatctatctatctatctatcgatctatctatctatctatctatctatcatctatcctgtctatatatctataatctctatatctatcatatctctatctatctatcctatctatctatctatctatctatctatctatctatctatctatctatctatcatctatctatcctagctatatctctatatatctctctctatctctctctatctctctctctctctatccatccttccttccatctatccatccatccatctatctacgtgactggtgtctataaacagttatttttttctgactgctgtctgtaacagttgtaaggagtgacagcagtgagatgagctgcatcaggaccactcttagggatagatctcatctttcttctgtcatccttttccggggcagctggagttgtcaggcatcttttcagcagcttctttgagaggagctcccaatataacgacctgggaccagtttttgaagacagtgatagtttcagaagcaagatgaagaatgttgattctttagcaaatgtcaaagctgatacatgacaggataggcaggaatgctttcctcaagaataaaatctgcactgccagccctggcatttctagattcagcagacaggcttcagtctaatttttcactctcatctcattgctgtacttaatagttttcctgggctggactgccaaagtgaccactggagatgtctaaaagcttccttgagctctctatttctgtgtctttgtgtgatagtgccttccatacgtgtcacttttcttttagcgccatttctccatctcataagctcacatcagatgctttgtctcttagaaatccttgctgtaaccatggacagatggaaatcatttctcttcactttagcctccttggttatgtaaacaccttattgtttcattatacatccaccagacacttaacgtgtactctgaggcatcagaaaattgggcattatgttagagagctcaccatgtacattgtcttcatggagcctgccatgttctagcaggtactggaaccagacattgttttacttcctgtaaggaatttgtaagtccattgtcccttgaatggaatgaaataaacttaagagtagaatttgctgcttaaatgaatatagtttataaaccaatggactttgtttctaaatacctttgaaagttcttttttttttttaagtttatttactttcacctgtgtgagtgctttagaaaatggtgtcagattccctaggactgacactagagaggattgtgagtagccacgtatgtggatgaacaaaacctgagtcctctgttcagtgctctgagccatgtatcgtttcttccagtgtttcatttctaagcatcttgagaccaacaattcatctttgcttttctgttcacatcaccaaagtttttctaatgaatccagtcatttgtaaatcccagttttgggtacatgtgagtgcttgtggtaggtaaacacagaagtgccattgtcgtcttctttatttcaatgatcttgtgtgtcttaatgcataactgaaggactgagtttacttgctagaaggtcaaacatatctgctgaatgcttggaatttcaaatggtaacattcagcatttgtgacaggatggcctcagtggatttgaagagttagtcaagattgtgttggagttaaattggtttggtaaacttaatgagaacacttacactaagggatttgagacaccagagccaaagaagtgggatgagagcaaattattatttttatattctacacctatactccataatgataacaagtgaaaactatcccgcttcattttagcattgctggtcttttttctatagtaattgcagagttatgatttgggttatttaactttcattctacagaggtacagaagacagacagtgttaagggaaaaggtgtacttttgacatgagagttactgttaatgacaggtagtcagaggtgacacttgtatgattttaaagggtaaaagtatgaatatatacatatatatgccagcatgcttagctatggtggagctgtgtctgagtaccatattgcagtcttaacccttactccctcctatatgactctccaaagtcccctttcaggcttgtattcttcgggctggttctgaagatccaacccagcacagacatgaacacagtgtgaacccgaatgaacctcccctttaactcactaactccaactgtgtgcagaagcttcagtctccactcagtccagttctccttaatgacacccaaagtaactgtttgcagagaatagggccaatgagatgataagctgaaacatgttagatgtctgtcaacagcatcaaaaattaatcctcagttaaacaacccagaggtttgtgttaagattagaaagaagcagaatcttatttggttgagaacatgagcaaaccaaatcatatgtgcaagtgcatcttctgtgaaggatgcttcacagaagtcaacaggtgagtgacgtacagaaacagtcgagctgcttgcaagatctgaagggtctaaagagtggaaaaagacaagagactgtggaattgatacaagctgagatgtataaggaaccaatcaggtttataaatgtgtgtatgctgcaagagaaacatcaaaaggaaaaacactgatgtctgtcttttctaacgtatgagactagtgcttttgagaaagggttttagatgcacctaaagagagataatggtgggggcaccccaaagtgatgttgaatccaagtgtttagagccaattcacaagagaggctgaagggtacttaggatgcttgtatactaaaagcctggaacatctaaaagaggagcaaaggagtatgagctataggctcaaaggaaatatgagtgtttgtgtgttacaaaaaagcagactcaactggagtagaatattatgatatttgtttcaggttgataaaaaggataagcaaaatattttctatctcattgagaaatagaagtggggggagcacataaaggcactgaccactgagcctgactacttaatttaatacttggaaaccacaagaaagaagatggacacttactttcacaagctgacctctgccttccataaaaacacagtggcagtgtcttagtcagggcttccattccttcacaaaccaccatgaccaggaagcaagttggggaggaaagggtttattcagcttagactttccacattgctgttcatcaccaaaagaagtcaggactggaactcaagcaggtcaggaagcaggagctgatgcagaggccatggagggatgttacttactggcttgttttccctggcttgctcagcttgcttgcttatagaacccaggactaccagcctagggatgataccacccacaatggactgggccctcctacgcttgatcactcattgggaaaatgccttacagctggatctcatggaggcatttcttcaagcaagactcctttctgtgtgataactccagtttgtgtcaagttgatacacaaaaccagccagtacaggcatgtttatgcatacatgcgcgcgcacacacacacacacacacacacacacacacacacacgtaattttataaagaaatcaaagtaatttagatataaaaaagtaaactatataaagttacacagttctgtccttgcagactgacacaacttcgcatcctctaggatgaggaacccaaattaaagaactgcctcacaggctgctttatgatcatgtaaataagagattctcttcgttgatgattgatgtaggaggtgacaacccatggtgggtggcactgtcagggaagcaagctatatctgagcctcagagcaaaggaataagcagtgaagattcctccaaggtctcagcctcagagccagtgtaccctgattttgctcagtgatggatgattaagaatataagccaaataaacatttttctcccacggcagcacagcacttttcttcatggtgtttattatcacaagagcagaaagcaaactggaacacgtctaaaagagtttgaaatttacttttacagcaatgtgaattgaaagtgatagcaacgaagaatctgtgaggaagaaggccatcagaatccagaatgaaccaaaagcaaagtgaggaaccacaaagagtccacatcacttaggacagacaactgaacgtaagagagaccagataggtcaacaaaggtataataggtaaaatttggacacagtctctgagactgggaaaagcaaccatgtgctatgtaaagcaatctgaggatgggaaaggcttgagggaacagaatatcttgtgaccattcaccaaaatgctataacaaacggaaagtagggataacggaaatatttttagtgaggttatttcattgagaacgggatctctgattatgccataccattaaaaaggaaccaaattctttaccattgttctgctagttgcaatgggaacaatagaaggcaactatcaacatgtgaaagtattcttggaatacatagcctttcgcttaagtggtatataaatgtacaggctgccatagaaaatgggtaaatgagataaatcagttcacttcaaactctgtagctgtttagaggacctgtaaacatgtccaaggtttcccacgctatcaacgtaagttaattgtgtctgtcttcctctttgtttctctgttctgacatttgtgggaatcctctccagaatcagtgatctttacctgaccttccaaccagcaggtcacatggtacctgacatataatcttatccttctgatgatcttgggaaaagcttatgcgatagcatagagcacacttatatgtgtgtctatgagagcagtgtgaaacataatgatatcatgggaactcttcatcaatgattcatccatcagaggatttgaactttttaaattaaaactatttatttattccctttaaaacacaatatcagcccttcctttcttcctagtaccccctcagacaaatatccccattcctcctttcccttctcttttgagaatgggagaccccaatctgggtgtcaacatgttcttccccaacatcaagttactgtagaactaggcacaacctctcccattaaggccagacaaagctgtccatttaggggcccaggatccaaaggcaggcaggcaggcaggcaggcaggcaggcaggcaggcaggcaggcaggcaggcaggcaacaggctcagggacaattgtttggaggaccgacatgaaggccaagctactcatctattatatatatgaagagggcctaggttttgtccctgttcactctctgattgtagttctgtccctgggagccccaaaggtccaggttagttgactcttttggtcttccttggagaccctgtcctctttgggttcctcactctttctgccaactcttccataagacttcctgagttccatctaatgtttgggtgtgagccttacatctctttccagtggcttctgggtggaacctctcagaggacagatatgctaagttcctgtctgcaaacacaacagagtatctttaatagtgtcagagatttgtttggggtggttggccgttcccacactctctgctctatctttgtccctgcacatcttataggcaggacacatttttggtcgaaagctttctgagtgggttgttgtccacatccttcctgtgagtcctgcctggctacaggaagtggccacttcagtaaccatatcccgcagctgttaggaatctcagctagggtcacccctttaggccctctggggcctcttcccattctatcatgtcctagagatgtcctcaccagtacgtttcccttctttctcctctgctctccctacatatgatcttccccaccatgccctgctcccctctccatcccctcttccacaaattccctccttccatcgacctccaatatctattttgtttccccttttgagacagattcaaacatcctcacttgtgccctccttgttgtttggcttctttggttctgttgattgtagtatggttatcctgtcctttatggctaatatccaccaataagtgagtacacaccatgcaagtcctttggggtctgagtttcctcatgcaggatatttttctagttctactcatttgactgaaattcaagatgtcttatttttgttgtctgagtactattctattgtatagatatatcacattttctttatccatgcttcagttgagagacatctaggttgtttccaatttctagctactatgaataaagctgctatagacatagtcgagtaagtgtccttgtgagattatgaagcatcttttgggtatatgcccaggagtggtatagctgagtcttgatgtagaactattctcaatctttcaagaaacttccaaattgatttccagagtggttgtacaagtttgtactctcaacaacagttgaggggtgttcctcttgctccacaacttcaccagcctgtgctgatctttgagtttttgatcttagccattctgaggggtataaggtagaatcttagagttgttttgatttgaattaccctaatgactacggatattgaacatttctttagctgtttcttggccattgcagagtcctcagttgagaattctctgtttaactctgtacaccatttttaaattgggttatttggattgtcagtgtctaactccttaagttctttatttattttgtaaccacacacacttaatgtaatagaacagaaagtagggaatagtcttgaacttgtcagtacatgagacaacttactgaacagaataccaatggcttaggcactaagatcaagaattaataaatggcgccttatgaaattggaaagcttctgtaagtcaaaggacaccatcttcaggacaaaaattacaacttacagtctaggaaaagatctacactagccctacatccaacagaggatttaaatttttattggattacttggacatgacaaagttgtagaaggtgatgcctgtatgaagtaggccactcggtcatgctgtggcttgcctcttttctgcttgctatgatgtaaaatacacagctccctcttgccattccagtcatagtggactacctctgaagccttgcatacaacaaacccttcctccttgtgttatttctgtcacctgggtttagcagggatagaaaatctaagacaaccattgtctctatctgcttcacacaatctttgacgtgagtaaaatgtggtttctttctcccaatgttttaatatatgatgatttcctcatttttgcctttcatttctatttatttgatgacttctaaagcattggaactactgaatgatctagtaagaattcaaggagtgacctacaaattaaaaatcattgtgaaagggaatcatacataagaggacctcataaaaaaagcaacatggaaataaggatgataaaaggatgaatctaacttcacagattttgtcttcttaaatgatgatgttaggttcttataaaaaatgtctgtggtctcattgaaaagagtttttttttttttttgatccaatgtgtactaacacatgtttaatatgtcatgttccaactctaagtcattaagaatcacttgttgcttgagttgtaaactttgtctatgctggtattatgatgtgataggatgagcagatttactgagagatttgaagaaagtgaaaaactaaagtcattgcaaataactatatgaactgaaacatttgaaaggaaaaacagaatgcatgattcaaaaagacagttacacttcctgcactcagcactgaaaggaatgaacctcaaaaataaatctaaatatacttttaaatgaacatgaacaaagcattaattatgaataatcttcatgacacacttttaattattgtcaatatagtgcttcatggagggagaatcagcatctacccaagagaagaatttaaagacaacatattcatccattcattatttccttatataacaaattcttaccaagtgcctgagccactcagtgtatgaccctgagaggctagggggatacgagtaggtttgggaggagtggtaggcaaatgagctactatttcatatttatagtggatagtctgtgctatcttatttaatggaagtgtttaaaacagaaaatatgtaagtacattcctttgtgtaaacacccactagactacaaagatcctgcattatctgtatacatatcaagtatcctggggaacatctaaccagacatgtaaacatattttatattcttaaaaaataagcctttgaaagaaatatttaaaatgccaagaaatgtaacattatatattgtcaggtttatgggaaattctttaggttgaatttgaggaaagtaatttctaaatgcatataaaatgtttaaatgtcattccaaataaaatattttacagtatgaaatccagataaagtgagaaagggtaattgctctgtttgaagtaatagtctcaaagtccaaggtaaatagagatattctaacataaacttttgagacataacaatagagccatcaagccagtctaatttggggggttgaagtttggcacttctcaaccacaaaaccctcataatgtaagttagaaaaacagaactcagatggaattccaaaataggcacagaaaccaagacattcttgcctaaatgtgccactttttcctcccccccccctttttttgttgctgtgacaacatgcctgataaaggtgacttaagaaagcaaaggtttaccgtggctcccagcttgagggtccccttcatcaagagagaggaagcatggatacaagagcctggggtagctggtcctgttgttttcctagttgggaaatggaaagaggtgaatgctgcctgaagttagttttttctttttaatccactttatgcaatgatataactcacttaagggtaggtcacctcaagtaaccaagcctagacactctcccacagaatggcttcttattgttaattttgaatttgacaatatggatcagcacaagatccccccccccttttttttgcttgcttatataacttcaccaaattacggagaacctgggttgaccttccttctagagtcaacataaaatgacatgaatcatactcatggtaattaactagaacctatgttttggctgccacaagaaggttgaaatcaacttcattgttggctcaaagggaagaaggacaatgaacaccaatctgaagggatccacatgtactcctggaccacagggaaatttcagatctgtagttggagttcaacattctcctgtggtcaacaccataaagcacttgatcaaagatggacttcaagatctgggaaatgagaggatgactgtttgagtgttttgtatagaagcattcagaatagtatgtattgcccaattgccttttgtggcacaaacatttcctcattcagtattactaaatgaggtaaggacaaagacatattttatgttgccatcatggctgttatgatccaaaggaaagcaattttcaactgggacttgactgagctgtgagtttagtgttttcccttactaagatcttgttgtgtctgtttgcttaatctctgttaacttctagctcatgctttggacaggcaagagatttcaagttctttccatcgcccacattttgtgatatgatggtatatggaaaaaagcagtctacatgctaaagcagatttatacatcagtgtatcagcagttcctccaatgctctcaaagctgctctttcctctccactctttcaatgactgttgttgaccctactcacatggatttgtgcttgtttcttttccacaagctattttaggttaacatttttattttcatgtttaccggacagactataactttctctgtcctatgtttccctctcccttatgttctcaggacacaacaccagttataactcaagcaaggtcagacagaacaagcaaccatgcatgtgaattcactttagttgtgttcctgctaggacttcctgaccaggaacactgaactgtaagcattttcattctttagagctacaatagaagaatcattaaataataactattaaaataattgtgcttgagagagaggtggggagaaatcaactctttaaaaaacaaatgagagaactaaagtaagttctagaaggggaaaaaacaatttcagagtataaatcactgcattgcagctagatccctcctgtttatcattatcaaccacacacaaatacaacacacacacacaaagatgcacacatccatatgcttacacaccattaaaaccttgactggcttgtatttttacgtttagttatgatcacacatgtgaatctgtatgatgatattcatggcctcaagagtcgtaggaggtttcataaatactttatttgtgttaggaatcagtggggtggcattattatccttacttcaatggatgaaacttgaaagtggaaggaagacatttgataattgagcataggaactggcagcagatctggattttaagacagaccccttaaggatatagatgtttatgaaaacaacatgacgtttcaatttctgagacgttgggaatccttgctttattgatgtgtaatcagtgaggacactcagttctaacttacagtatataatgacgcaacacaagtaaatccacgaactctaactgggagtttctgatattgttaagtagaatcccccccttcaaggagtaatacgccttttatcaatcttacattagctctctgagtttgacaaaattgaaccatatcaaattgagtgaattggctgagggactgtagctggtaatgaaagcgctaataccaatatctacacaaatcttagtccaaacatttaacaaagtctccttaaattatgaattagatggagataaatgtggcactaagggactcttggtacaaattccatatatggagaacagtgagtcgccttgcagtgtacatttagattatttttatagaattcattaatgacttgatgtatcccagcttctgggttttgttttgttgagtggaaaaaactgaacaagaacattgtacctattaaaactcatgtgttttcttagactgtgggggtcacagagatgactaagacagctaatattacaggtgcaccatttgcaacttttaaccacttgggatcccaattgagactgaatgcacattgctgggttttcctagttttcaagattcgttccttcactttacctaattttctcaggagagatacagatagaatgacctccctataaatattcagagtaaatatctaataaggtttgcttttgccttcccagagtgctccagtggctttatgcctacgagtctctggggaactcagacaagactcaggactggggtgcctgctggtctcaagattctgcatctccgacatggcaaattatcaccacattagcaacgtctcacacaagtaaaatgactttggcttttaaaaactcatctactttatcatagcctgatgttgtacacttttcatgatactttatttcagggcaaggatataactccaggtcataatagtatttttcataggagaatgaaaaatgaaggaacaaaattcatgttccctttccttcctgggtagttgtaaaacaagtagttgaattcactctaaaattccttatgaatattcagtgtacaatctttatgcatctcatggtttcctgctattaaatacaaccatactgatgaataattgggttagaaatatgcccttattacagctaacctcagcccaacccaaagccaagcctgtatgtcacccagataaaggactctcagacaatgtataaaaatcctcaaaagcaagaacttacttattcttttgatcaaaagaaaaaaaactggaatattcacattgttttcgataagaacaaaatattgagtattttaaattagtgacaaaatgaaaatattcatagaaaaacataaattggtaactttgataatagctattatttctatgtcattccatgaagtttttaatgggtagatctgtccaagtcaagggatcagggaacacttttgtgatatggctagttgagttcaagtctaatgagttgaacttaattaacccaaaataaaagtgatagaaaaatcgtaagaatggatggggactgaatctctcaggaaaaaaggcaccaggtaagactgaggaaggggacccacaggaccttgtaagttaccctgagttgtactgttcatcttctaagaacaatggagacctagaaaactggggagactgttttctgcttgctggcttctttctcatttgcttggtaaaggaatggagaaaggtagtcaatttgcattttgaaaagatggctggctacatatggtgagacctgtgtggaggggatgacagactgggggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggctctcatttgtggtgattgaaatgaactcataaattctctctaggatgcgggaattttttgccctccccgctgagagatttaatggatttgcggcattctgaatgatttggcaagaaatcagaggtatcggtgcagtcacccacaaagggcactttagtttctcgcatgtgatagtcaaccaccacaaaatattttctgtaagaacttagaatgattgatgcaacccaccgtaagtcatgacagggtgtcaactgaaaaactgaaaaaaaaaaaaaaaaagaagtggttaaagacaccacagctttcaaaacaaatttgacttttagagaagggttatttcctcttggaaaaaaaaaaagttagacctgccacctgcaggaaatttaaatcagttgtttgcagcagaggacatcatatttcgaggccactgagagttcctcctgctctctctctgtatggaacagattaaactgttcccattcggtgataaatacatcagaaaaaaaaaaagctgtaacaggaacacagtagttgtagcagttaatggcacagcttcccgttaaaacaatattctttgggtttcttcggccagttcccactttatgtgtgctattttttgatgagttaattttttttgaatttgcataatcaataactttcagagctgtatagaactgaagaaaaccgaaggcaagaactctaaggggcatggctggctggctgagattgggatagcaggacgaattctgagaatgcaggagtaatctatcaaagcagcaggctgggatgaaaactaaatcctaatgtgtatatgtgggaagaaaatgaaaaaataacccagagaagaaattgcctttgaatttcttcatgacaagcaaccattgcctgaaacatataatgcaaagatgaaaactgttaaaaaaaagtagtcatcatattatgtaagagaatattttcagagaaaacgaagtcaatttgtatgatatttcttagtacatccaatacccgagaacaagaataatcccgggagaacttattctgttaaagtggtgagttgtttcataaatcaactctatgaacctcctttcttatgagtaagaaaatctgcaagacattagctcacatgttcagtctttatttacaagaaggaaaaccatgacttaagacattgaggtccttggatagtggataacaaagcttggctcactggaagaggtcttactgagtgttgatgtggcttccaatagacttcctgtgtatgggaaacccttcctgtgaaaagattctgtgaaaagattctgcgctggaaaatatgtcagatagtgttagatattctttctttagttgtaaaataatgcatataaaggttgaatgctaagatgccttcctggttctatactctcaaggcaactttgttacagaaggcataatgactacatattattttaaaactaccacttgaagaaaagtgccttgcttactttaaaaatcaacctttgatgccacacattgcaaataactttcagtatgtgactttacaatggaaaagaagaaatgtgtctttctaaaagcagctgcaggcagattagaactcagtgctgctcagaagtgagaggtggatatatttatgagtcagtagcttagagaacttcttctgtgggaacatcagaggcctctgtaaaacactgaaggcttgaagtaggaaatctgaaggaaagagtcattgcacatctattgattccaaataaaatcgtttctgcctcaccattggttagaacattgtataaatgacatttctggtttgggttccatgaacctacaataacagaattacctaagatatttttttaatgcttgccagctccaggcttgctaaagcagacgttttggcattgggcatttttcacaagtttcatatgagacatattttgtttgtgtgttatcaaagtttggtaatacgtaatgctcgaggacatttgaatgagcagaaaatgctatcgcacttctcctggttcccacagagaaagcaccagagactttggtgctttccaactgactttcttgaaaattccatcagtttctgggatcttttcttaatgacagagcagaaaatgttccaggcaaagggcaaaataaaccataaggcttctcaccacgtatcgtctagattctgcagaacaattttgcgtgcaagtagctttcctaatagtaatatttattttctttcctagtgtgtaaaagcaatctggctttctttttttgtttcctttcaatattagcatctgaacttaagaacacccttttaactcctttctgtaagacttcctgtaatttatcaatgcctcttttgtattctttgctaccattttcaatcttcaccatgagtgcactccgtggttctaagaatccataagatgtctgtcagcaccatggctatataatgacaggactctaacccagcatccttcacattccctgaagagcgaatgttactccatttcaaagagctaaagaaacatctgccttactaattatgaagctcacttgctaaagtaagaatttttaatattgtctggtcacgatctttaaatcttcagatatttgaaccattctagttaggtctgagtaggatttttgaagttgtgtacttaattgtttgtagttctttgcacttgataatgctaatatacccctaaaagagatatcggaaaggtttcagttgattcaaatggttctcactctctgtcttaaaatttgttattttacaatttgtttttaattttttcactgagaatttcatatggtatatttgcaattcctgtccaccaatttctatactttagtctcctcttgcaaattcatgttcttcctctgtcttgcaacaaacagacaaaaaagacctactatagagaaagactaaaacccctggaatctgatttgtgttggccaactaccctaagcgtaggtagctggccctgtgttgtgatattcactgatacttgattagacaaaaggagccttccaatctcagcagttatttctgaatacactcttggctagaaataagctttcatgcccacctcccctcatgaatgctggggttttgactggctttagcttcttacccagctttcatgcatgctgtcaacagtagctgtgaggccacatgttcctcacccttgttaggtctggaaaccactgcttccttcataacatcagccctctctggctctcagaattttaccatctccattttctgcatatatccctgaaccatgaggaaacaggtatgataaagacatcccatttatgactgagtccaaagtctctattttctttatgttatacaattgttaattaccctctgctctgttggcagctaaacaatgcactaatctatgtgtatagcagtatgttaataggagacacgctttttctaggctcacttaccagaatcacagtagtggatctcatgacctatctattctcaggtctttgtgcttcatggcagtcgtgggtacaggttctagcatgtggaggaggcctgtactggtttaaataagagtggccccaatatgctcatacatctgaacgcctagttaccaaggactggttctactagaggaggaatagaagtatgacctgttagcatatgtgtggatttgtcagaaaaagtgtgtcactatgggtgggcttttgaggtttcaaatcctcaagccagattcggtgtctctctcttcctgctgtctgtggatctggatatagaattctcagctgcttctccagaatcatgtctgcctgctagctgctatgctcctcactgtaataactgattaaactgtctcctcattggggaaagagatgacatctcttataagagttgctttgttcatactatctcttcatagtagtagaacagagactaatacaacccaaaaagtgattggttaagcatcagtgtaactattgcaccagaggatatatctttttgggttttttttttttttcgagacagggtttctttgtatagtcctggctgtcctggaactcactttatagaccaggctggcctcgaactcagaaatctgcctgcctctgcctcccgagtgctgggattaaagggtatatcttaaaaaggagttgtgagcatagcttttagggcttgcaactaggttgaaattgataattatattaagggcagattctaaaactatgaatactagccaaatggagatgaaacttccatttgagttaggtttctccactttctaagccatatggagtgtatgaagtcttactgtcaagttatggaaggtaaccaatagtattggcagtagcctatagtgtttggggggtattcaatgagaacactattgccaataattcaagaagatacaaccaaatcgtattgcatggggttaagcaggaataactatttgtttttgaaagtgagtgattcatttctgtgatgtgctctccttggcagccttgcaactcttggatagacttaatgcagttatcaaacttaattactgtgctcagtgtatataaaataatttcctacaaaaatggaatagatctcccttggctatcacatgacttcaattgagccagaggaactcccaggcaaacatagtcctaggcaatgagcaagccaatggctcaacgtttgggaaaactgtttagcccctaaagcttctctcttctgttgtttatgttcagagtgcagccaattagtctgtgtctccagcaatcaaggtgggtcctcccctcccactagatgccaaaatcagtgttccccaggaacaatcctcctagcttctgtacttcctttctgacccagaatggttccagatacattttatgattcttgtattgtctctaagatagaccaggtactacatacagctcacatgccatattttcttttcgtgtttaaaagagcctctgttgaacaattgcattgatttttaaacttctcttaccacatgtttcatggttaaaatgaatagaagtcttgttaaacttttatttgaatgttactcaattagagatttctattatatttctgaatatgtcaatttttatcactactaccgatatataattccagcgagtgaaatgaatgatactttgaaaacagtgtatattaattaaattttttacttgtatgcatacgtgcaacatgctatttgttaggaagttagaatgacatttcagaaagtgaataaaatgcttgcagtgactgctcttgagtgaattcggtcactctcataagactttgtcacttataaacagtacatagatgtgttttatatcacggatatggtgaaaacaatcaaggcttctctgcacttcaaacaggcctatttaactattcagattagagatcattaaagagtatataatcttaggcatgttgtaattggaatgtcgcctatccaaattagaaagaacacatgcacctgaaataaaactcataactattataatgtatgatatgtatagaaaataaaactaacaaaaataataactataatccagaattcttagtattgatcccagttatattatgcttcctgggttttctgcttgtataggaatggaaatttgaatatatatatatatatatatatatatatatgaatcattttgttcaattaggataaatatcaagaaaaacaattctgggaactcaaatggcttgctactggaaggttaattttatttcatgcttatgaagtgaattatttttatcaacatcaaaatatcaatatcaaaataattttaatgtctacatcatagtattagtactctcatttttcatcatgacattgccatcactaaatgggtcactctgggaagactcaatttcagtgcattctctctctctctctctctctctctctctctctctctctctctctctctctctctctctctctctctctctctctctctctctctctctctctctctctctctcttttatttatccatgcaatgctatacagacaggggagcctggagatagcattttggagcacatataaaagagaaagggtgaacttttctccttgctttttattttacagatgaaaagatgctgagcaagcatagtaatcaataagccttgaaaaacattgcaagcttgaggagcagtacaggtttcgtccctagtgtccgttgctcatccatccaaagctttagtcccacctcttattgttgactgtggccctcttcttccctggctgaagctcttcaatcgtttcccaccctacacagatgtatattccaaatgcatccatgcctatattatttagtccatcttatcattttcttagggctaccacagcaaaacagtacacactaattggcttaaaataatggataagactgtctcacaacttctgcaggctagcatttcagaattgatgctcttctgcccagatcctctcctattccataggatccccatccctcctggtaatcggcagctgctggaagctcagcacacctttgtaagtggtgccctagctctggctctctcacgtgtcttcacatcatgtatcttcacatggacatctctatccaagagctccttttcagctcttcccttgtgcagggccaagtactcccacaaattacaggatgccagctcttttggatgataggccgaacttatttcactataacattgtcttaggtacatttgaaacaacttcatttcttttgtattatgtacaccagtgcccaagaagttgaaagagggtatcttaatcactgagctggcattatggaaggttccaagacactatgttgaatgggaatggaacctgagtcctctgtaagataaacaagtgctattaactactgagacatctctccagcccccaagcctaattattttggtgggtgcatactattctccaaacatattctcattcataacctgaccattggttaacacctcctacagctttcattcttctgcttnnnnnnnnnnnnnnnnnnnnncctcttctttttcctcctccttcttcttgctttcattcttttttaacacatttgttttaagaaattgcttccttttgccagagcatacctacaactctcatgtccacttctatcatactctgtgttcactattgaaaggcctgtaccttttcctgcatctctaggtatgtggcacattcctattttctcataagtgaagcatccccttacctttttaacagatagttgttctactcagtcctttcactaagtgtacaacgcacattgccttgtctttgtgtcagtcacctggcttcccactaataacttgtggaaagccatgcacacgtcaacctagcattggactaccctggtaaagtgttcaagccagtgtagacagtcagtaaattttaaataaaggatataaggtcttcccttgagacgagaagcctggcaggtggatcccagaagcaatgacttagtgtaactaggagttctgctgagggatatcacaacgcaagacgtaggacaagcataggaatcagctgtagacgtctcccttgctgtgatgtctattccattactgaagggatttcttcaatactaacctccagctgagacgaccttgattggctgaaacagagaagatgattctgtggaaatgatatgacataattactggctagatctcgacttctaaaagtcacaagtccatgcttccttctggggtcttatcacattgtacacttcttttctgttgaaaaaaaattatcagttgtccaaggcaccatctccacaaaagagagtttagagattcaaaatccaatattcagagattagagggtcatatgctactggagatgggatctgtaacttccatcactggggaagaagtgatttcatttccatgaatgtttgccagagagctagtgtctcagaatcagtctgcaatcaggagctgacctgaaagaaagggaaatgcaaatagtcaggttcccatatgcataaaatcagaataagtacttcacacaaaggctgttagggtaaaataatatatgtaaaaaggtgtggaagccttgggacaaaatgttctatagatcaataatagatcattatcatcattaagaaggtatgtgaatttatattatggatttcaccataaaacaaagtatttttttccaaatgattcccggtctgggtttcaacaaatttccagtccttttaagtcaccacattcagcactcactgactacaccgcatccttttcactgaggaggggtatggattctggggttctaatcatggcacttgtcagtctaggaagatgtcttgaagtatgcatacttctggagaagagattcattcaataacacttcctgaaccggcatcttcactgagctgaatgacagtgcaaacaataggcctacattctgccttcaaggtacataaaagaaaagtcaagcatctagggggatgtgcctgaagaaggtcctgtgaagagtcaacaaacagaacagtgtcttactgataacaaggagccagacatgtccaaagaaaagaaacaaaacaaagcaagcacttcatccctaagtaaaggccaagacaagagagaaaagcaatggttggctgagcacagtaagacaagtccacatgatctgatgagggaaagggcagtacagagccagggggagaggctcagatgttaaggctttccaagttacagggaatgactgtgaagttcagcggcaaacccacaatgaaagtactagcctgaaatataagtgaaagcagaacttactgttcttatagaaatttcccctggttaggcataaacatcacagtcaaataccatgacagcacgtgacaatacaagaatatcaaggtagcagtaaagataggcactctggctttagaagttgggagggacacactaccagaaagttgtgtgtcacaacgtgacaactttctgaattgacttcacatgccacatccttttcactcaagagggatgaaagaccacatcctggaaggtgggtggggcccgaggactagccatgtcatgatttgcactgttgcagtagatggaattcagatttactaaggcattttccacatcagaaagtttgtgcatactctgagatttaatcccaacgccaatcccaagaggaaatagttcaccactgtaaccaatatcaggacttagatctatagagcatacactggtcccaagttcacatgacatgtctgaactcaatgctatattagttttacagggtcccattacttttgtcacctcagaagtcctcgtgcctaggagaagcagaattttcagccaagcttttccacagacgactaattatctaagtatgtagctcactgtgaggacactttaggtgctcagaattcttggccctgaaatagaacagagtctgattcctacccaacctgattttgttttgtactacattgtttgtcttgggctgctgggcacaaatgttaatgaggctaattgagtcatcagtctactcagttgacaatgaaaatctagcattcctttctcacaaatagagcttttaagaacaagtttgtttatgagagagaaacataaatgggttgcacatatgtcataacaaggtcctgtaaaggaccattctaatttgcttcctagtaaggagaaacacaaaggctttagtagaaagagctttggcagctgggaggggctgagcttcactgtggtttacaatttgggtaggatcctcgtgttgtgtgtggggtggagaggcactgtgtgctatgtattatactgattttcttagagatctcctgtgcgtcccttcttgatcaatggtaaaagtggaattctaaagaagtgaagttacttcatatatatataagacatgataaagatttaattttgttgtgctgtagttttacactaaaagcatccacactattttgttcctttgttactggactaacacacaaacatttcgccttgtaattgtatggtagaaagagaggaggacatgaagatgatgggaatccttttcataagcggtttatatattaccatttatagtttcacaactatagcgttctctcaattgataaggtctgaacgactattctgagcattcatgatatttccataaatctctgatgaatgaagatataaaggagataaaaatggtctttctcttcccgtttaaggattgcttttctaaggaaaggaagtacagatatatctcctcagcaatattttattaatttcatttcttcttcagaaggttgacaggaaatcatactctatcgatccgtgtaacctaccttcctctggtgattctgaggaacaaagtatgatcttagcaggggatttaaatagcatatgtcagaaatagtactttcagactaaggttgacttttttttttttttcaaaatatctctactgtcacagctgtgataggagcagaagtcgctttcagccaaatgagatataattcagatggtactaaggtgattttcatttttgtgtgtaacaagaacgtgagtttttaggtgtttggggctgtgataacaaagaggcagagnnnnnnnnnnnnnnnnnnnnnnnnnnnnnnnnnnnnnnnnnnnnnnnatgcagtggtgacagttcaaatgggaggctggccttccagggtaaaaaagctttactcttgagtcccatcctgtctatagagtcatacttttagccatatcattatgtcagttttgaaaattacagggtagaagtggtaatgataggaatcatgttctgtaattagctacatattttctacaacgaggagcttagcaaataagataatgtttcaaagggagagtaaagatcttagtgacaaattacacacatgggacagcacagacttgtcaacgtcagattccatttacggatggttcatcgcaactgccctttagaagctcacaggctgacaccttggttccagtcttgggtggtggtggtaggtgctggaccctttgaggatgaggcatgttagaaggagatgagcatactggaagagtgttcttgaaaggaatattgggatggtgtagtttgctttctctctctttggttcttgactgtcatgaagcgagtaagatgcctatggagtgtactcctaccataggcccagagcaacaaaagccaaaagactgaaaactttaaaaccatgaacgaatggaactttggctacaaatatgatgaatgcaataatatatcagctccactgtttataaaaaaaattgcaggcccaaagagacaaagcaatttgcagaagggagagcaggaatgaattccattgatatttcatgatgatgagatgaataaggggtgagagaaagtgtcagcttcagactgatactagaagcctgtactccttagttttagctgccaacttgatactacctagaatcacgtcaaaagagaatctcaatgagttgcctatatcatgttggcctgttggcttgtctgtgcaggactatcttggtaattgaatataagaagtgccatcccaatatgggaggcaccatttcatgcacaggactctagactatgaatgttagctgagcagcaaacagcaagaagaaagtatgggtacatttgattctttctgcacttgactatggatatgatgtgaatgtctgcttaagtccctgccttagtgacccttcaatgatggactatagcctgaaattataataaaggtaagctcttttctcccaacagttattttttaatatttattttacatatttgcatgcatgtatgtctctgtgactgtatgccacgtgagtatttattgttcagaaggttctggatcctctggggctcgagttactggtagttagttatgagccaccagccatgggtactggcgacctaattcagatcttctgacaaagtagtaaggactcttatctactgagcctcttccccataagcactcttatctactgagcctcttccccatacagaagcacgcttaacctctgagccgtctccccatctacagactgtgttgcttttgtggggcattttatcacagtgactgaaatgtcactagaacaaggaagtagcaaggcaacaaatgagtcagggaggacctgagaatccctgagagcctcagcatttgtcacactcgaagggagattcttggtctttcaagagcccaagcatgggtgattactttttgcagagcctataaagtgcccgtaagaacattgaggaagatgggggtggaaagactgtaagagccagaggatttaggactatgctgtgagactatgtctgaagctatagacacaactcactgtcgtgaccaaccacacatgagctaaactagaatgacatcagtgggcatgacaagtatacagggaaaaccctaaaagactgcaaccctacagaaggacctctaggcaatggaggaaagctgggatttctcaagggaggagcacactaattgtccaggtccaaaatgtctgccctggaaacatacattctacagacttagcagcctatatttaggagcataactgtattcaataaccactattcgcaaaagaggccatgaatttaaagaagagtgggaatgggtacatggaaggctttagaagaagaaatactgtacttatatcataatctagaaagtaataggaaagaacttttaagaaaacagatccatgcaaggaaagaagaagaatcgtaataaaatacacagccatggataatggagaagcaaaggggagcagacaggccagagagaagcattgaggggataacccaggaaacacactggcaaatcttcacagctccagaagctagaaggcaggtaaacatgtctacattctgagagaaaaatctcaggtgcaaattccacataacgtaaaaacggggcgtaagaataaatgatctgagggaacggcattctttctacattatagacatttagttctgcaactaaaactctgactgaagagatttccctgagacctaaatctgttgagggagaagaatgcaaccattgactgggaaattaaatgtgagcatctggctatcttcacacaccctatgtctaattttaaatgttcacatccaaatctctctaatcctaccttgatcatgaacgtcttggcctacagcattgtgagaagtcagactttatttcttttagaaacggtcagttcgtcacattttagtataggagatggaatggcctaagatacctggggaggtccatcacttatcagtgaatatcagtgaaactgatattgtcctgaggtccattccagtttttcatgatatgaattaatagtgctcagatttcagtctgtaaaaagtgtttgctaggtccttagtcatgagtcttaatttccacatttcacttgccttaacattatgtccaaataatgatcatactcattttcatacttctaaaagtttgtccaccctacaatgttaaaagctatttttagttcagaaaagttgaaaatgcttacatccaacgaattaaaaatgtaagttcctagagcctccttccttacttcctgccattcctgattcctgaagcattataactttttaaaaaatgtgctgttttaagattttgctgaaaggacccagatatagctgtttcttgtgagactatgccagggcctagcaaacacagaagtggatgctcacagtcagctattggatggatcacagggctcccaatggaggatctagagaaagtacccaaggagctaaagggatctgcaaccctataggtgcaacaacattatgaactaaccagtaccccggagctcgtgtctctagctgcatatatatcaaaagatggcctagtcggccatcactggaaagagaggcccattggacttgcaaactttttatgccccagtacaggggaatgccagggccaaaaagggggagtgggtgggtaggggagttgggggagggtgggtatgggggactttttgggatagcattggaaatgtaaatgaggaaaacacctaataaaaaatttttttaaatgtgctgtttgaatacaatattctaaatgataagtatattgttttttgatttacgtattagaaaagatctattgattcttgtttttgtccttgaggactgtatattgttgtctttctccagatctcatatccacttagttataaaattatgtaaacaataatgtttatggctgaatcaaagagtgtttcatgctttatactttcttagttgttcagttttacaatcactggctctattccgatatggctgttttctttcatataaattattatgatttcaacagagatactctgtaaaacatacgcttctctccccacctctctcatccatctcttatgaaatagtccctcgtctgttttcaagtcatgtcattttatgttttaggcatttccccttctgatcctgtatattgtgtatactatgtataatattgtgtataacagattattcttcagttccatctgctttcctggatgaggaatgagtttaatttttctttatgacttatattttgttgttgtttgaaggaattttcatattgcttttcatagtagcttttccaatctatattcccaacactactacataaagctgcctctcaacatctctgttgaggatttaaatatatcaattctggagttctacaaactacaggcattcagaccacagcactgggtaacttcaaacttgaaaggatttttacaatgtatagaggagactgagaagtattcttactgacattacatcaatctgctttagcataaaattagagaagattgttatgatataattaaggttagcactaagtagtgataacatctacagcaaagaaatttgaattgaaagatagcttggtcgtcaatgtttttatacattcttgaattgattttctctacaactacctcaagctactgagcattatcctcccagaccacactaaccattcctgaccccaactaccccataaatcacaaccattccatgccaggatctcttagtgtgccaagacacaattatgacatagagtgatggttatgagctgaaattttggattgaatcctgacttcagcacttcaaagatgatcacattagaatgtgcccaagagaatttgtaaagattgcatggaaaatataaacaactcacacagcatactttatgagatataataagcacttaaaaccataatcacttcataaatattattaagtttgaggatgagagtcattcatgaatattatttttttaatcacacatgaataaagtttatctttattgtgggaaccactataacatctttatatgatttaaaattacacagcaagtatgtatttttattttattaaagcaatcagagagatttatatccatgcattaattttatcatctcctcatttattcagttccttttaaaccttgcctctatttctgcttccctccatctcctttccctgcttctcaagcatcgtccatggataaagtgaactgagaatttctatctctttcaagggagcttcaacctgtgtgattctacaaccaacatcacagtaccttgtactgcattttctcgttagaaatttaaaatgagatataattctgcagggccaggatgtcttcaagaaggttttgcaaatatccaaagcctcatggaacatttatgtttcatctcccagaaatattctaagtgcaagagttactctctcttttttttaacctccatgtatacacagacacacagagatacagacatgcagacatacagatagacagacactcacatacccagacacaagggtgcattcaatgaaaaaaatatatattaggaaaaaaccacaaagagtttccagtggatgtccaaatggaatttttgtcttctctgcagacaatttttaactccccaaggagtccactcaatttttaatggagcctaaagcaagaacaaagcataggggttaaatacatttggtgtttattgatatccagctagaatacttatacatccatctcaacatgtaatttttgaggtgacagaattgtcaggaaaattaattaatttgggcttttttttttttaagtctgccatcccgaattgtcagtaccgggatctacctgttactttatttatacaagcaaaactggtcaagactccactctaagactctaaactatttaggagacatgggaccagaccatccttgtttgtgcatttataagaaatatgtcccaggtaagacagggtgtcataggagagattaatggaaaagatttcaaatgtaggcttgaagggactccaggaagtctggaagatgggattagtaagcagagacaccagggagtgggtaaatgactcccagagcaagggaaattcattacggagcccccagggaaaccaccacagaggcaggttcctgtgatagatagctcagtgtctgaactttctctggagtacagacagactggaatttaacacctctgctcagaatactttctgtaaatttcccttcacagcatagagaagagggaccctgatctgaggggtcaaagggaaataggccctatcaagtcaagctgctttgatgattgactctttttattcttgcaaggcactgaaatctgaatattgttatggcttagtctcttcttctgtgctaatctactttacactgtgactttcagagatggagtacatgatgctgctcttattttgcttaatttaatagttttgaaagacttccctatggccctgctcaacaagaactagaggcacagtcagcaatggttgtttctcttcttttctttctttctttctttctttctttctttctttctttctttctttctttctttctttctttctttcttccttccttccttccttccttccttccttccttcctttctttctttctttctttttttttttatttttgttttttgagacagggtttctctgtatagccctggctgtcctgaactcactttgtagaccaggctggcctcaaactctgaaatccgcctgcctctgcctcctgagtgctgggattaaaggcgtgtgccaccatgcccagctgttaggttgtttctaacattggtctcagatacagttgtctctaagttacaggagcatataattgtaatgatcaagcataggggttcggaaaggcacagctagagtgtgtatctaggctcattccaaaggatttgatttcaaaatcatacactgaacaaagaaatgtaaactatagtcaacaagacacttcaattcaattttattctttacaatggtgaaggcagtgatgcagatggaatcctcagccaatcgatatctttatatcacatcccatccatcagacagaaatttcccatggtaactactttctgccacttattatttgacattgatggtgacggaataaatgtctggtggatcaatgaaacagcttgtataaatctcactctaatttctcgaaatatataccctattttctcacttccattgaaattttttgagaattttgactcaccgtccatgatacaaataggaagtggttgtggacaccctgtcccatacttgtttcatcctgtgcatgttataaaatccttgaggtagcatgtgaaagcaaactaccaagaggacacttttgcaatttccttctttcacacatatctgaagcaacatgtggcccagtggctgactcgagccatgactaacggaaggtgtattcaatgtgaatccttacctctgtcttgttgtagaattgacttctgaactggaccatttgggggccactcattaaatatctaaacttccctaaaatataagtaagttaatagaagcagttgttacacgatgtcttccaaacaggactgcagcatggttgcattgtaataagagctcatacatcataccttttcaccatcagagaaaaattttcctaaatgaatgaaagtctggaatcacatctttcatatataaatttaaacaaaaatattaattttatttacaatttgaatccaccttatggtattaaaactggtcaaatgcttagatatacaaacagatgtttatatgtaattcttaagtataatattgtttactataaaaatcatctaatttatactctgataatttcatatgtgcatacacttaatcttgatttacatatacacctgagtccccttgttatttcatctgagatcctgaacccctccctactccttgtcctttcatccttcgtagtgtagtaggtcttctctagggtccatgacatctccagccacaggcccttggctacgtttacagcaccatgcaaggatttcctgttgcctgggccataaaacccatgagagagctgtttgtcatccccaagagagtcatgctccgattgttccactgggcatatttttctaagcaactagttcttagcagtttgcataaatgtcttctgacaccatgggagctacttctcagacgagctttcctgatcagttcctgtttaattcatctaagccctatgtctggagtgtgtactatcttcatcaccatatatcatgctcacatctgggaggtaaccaaggacaatgacaatagaatgcattgttttgtttgactcttggagttgctctcaccaccaattaagaactagaagggtgtttccggtgactggcatggaggtttaagttaggggtttacggcaatttggaagagcgttaatatcaaatgttgcataactgcatttcagctgaacacacacacaaaatgttagtaccagcaatttgaatattcactgttttagttgtcattataaaaatgtaaactataaaaaattctccaaatataactttgatatttaatattcattcattatctacagataatttttggtgtaaactattctgaagtgatggtgcataagggcagcccatattggcattagctttgattctcagtgaaacgatcatttaagaactatcaccattatcctcctcactgaactgatcaaattccactcctgaattaaacttccatccgtttcacaaagagatggaagagtacaaggagcactgatgtctcagataagaaaatatcttttcatggctcttaatttcttagttaatcccttgggttaactgagaaccacccagaaagtttacagaaagtcacactgctagggaattaccgagccttaggttttcaggttgtctggtgttattcccctgtcattgttctgaaaatactaacctcttacttctcaaaattaccctcctgtcactgcagctgtttattaactccaatcctcttaagtggtttatccaattctattgtagtgcataaaataccattttgttcttgctagttaagaggtttattgcatagaaattgagtacccactacgttcaatagcacagagtgggtattcaatttagtatttaagcgaattagtgaatttcagctgggactccaggacgaaggcagagaggtgggagggacaactgagaaaagagggccagagcatgattcttagagaagcacttcctaaaaatatggtgctactgtttttaatctgaggagtttatgagcagaaagtacaagttttcttgaagcaggccatttagccagagcctgcatttgaaacaatctgcacaagctcatctgataagggcttcatttttcaaggaagtctgagcaaccttctcttttatctggatctctggatctggctttcagcaaaacctttaagacatattggggctattccaggcccacttagtagacactggatgccttgtctggagagaggactgagcagtcagtagcatcacccaccaaccaggcattaccaggatacagagtacgtatactatgtagcaggaagtggttcttttattaatcagggggttttaacaatgatatgcttgctttttcaatgtcaccaatgcccactcatcaatatctggagctagaatcctattacagttaggtacttttaatctataccctattacggtagctttagggaggattaatattatttaacttcaaattgatcgtcatgtagaaatatacaattatgtattgagaaagatacagacatatgtcacatttaaaaagtgggcaatgaaattgaaaggtaggttccctggaaaatttggaaggagaaaaatgaaaaggtggaaatgatgtaagtgtattatataacctcaaataataaaatattataaaaatataaaatggaattctttaaatagtctcaaacttttaaaaatccacaatattctgtttgatttcatttaaaaggttcagatattttcctcttgtgccatattttttaatgtgttaaattcttttacataaactgagaaaataagttttgttttccaaaccattacacccttagtaattaccgtagccatgtcaaaggtgtgagctaagaattatatcatagaatacagcaccgagaatacagtacagagttaccaaataattacggtaaggaaggaaaggaaaaaaaaaaaagaaaaaagaaaccttcaaccaagcagacactgaagtcacatcctgaccagaggaaggaagtgtcacatcagacacttcctcagtgctatcagatgctgggtatcacggagagcacccgtgcctgctctcagttgtctctgtaacagcagcaactgtgctcactagaggtggccagaattcaaaatgctaaagaggaagccatccaatgcctcagacaaggagaaacaccaaaaaccgaaggtaagtttattttcttacagagtaaaactaaccaaatactgtactagaaagcaacacttacttgcaaatgtataacacagacacaccagacacacacacacacacacacacacacacacacacacataccatttacacatacgcacatatacgtgtatacacacacatacacaaactcattcaagcacacaacacattcaaacaaaccacacagtgacatacatctctctctctctctctctctctctctctctctcacacacacacacacacacacacacaagcatacatgcacactcacagcctacatcatcaccctactacttacatgacattttatctgtcacttctaaattaatttaagtagaggactgagtgcatcaaaatacatatggaagaatatgcatactgatgagcaattatggtcttcacaattgtgtattagattcaaccctttatgttgttagctaagattgggttaggataattttatggaactctgtttggtggcctccacttaaccattaatatcatgaattctctgcctatttttcattccttggttgttcaatatcttaccagtgttctgaaggaattattttatctgttaaattgtagatatttaaaatacataacagtaagaagactaaaatggagaaattttaggttagttttttaaaattctttttgtaatttgaatgttcagctatgatatcttgtagtagacatgcattttcacattgtcattagagagaattgtgccctattttgagaagacacaaaatttataaattagtaaatttgataagccagtcttatgtagtatgttcttttattctttctcttgataacaattggcattaaaaataatataggaaaagccaagtttacatttttatagaacgctaaacgtcatttgctagtaacattaatttctttagtatgaagttgtgatgtcagaaaatttctgtcctgtttatacattcctaacgtttctcaaataaattcaatctttttgttggtgagataaatactagtggattctttgtttttaaggagtttacactttgtcatcagcttttatttctcattgggagagagacagtttggggactgattttccttctgaactgagtaggcacaggacagtcttcaacggtttaaaacctttggcaaaagatctgaagtaaactgagaattcattatttccaagtacaggaaactaaaactagatgattttcaacattattgtttctaatgcaaaaaaagtcaacaaaggttaaacaagcatcttagaaacacatagtacaaaaatatattgcactttctgttttttcattactaaaataaaaattcacagcaacacatcccaaaatatccaagaaaggtttttcaaagaatcattttttatttcttcatatgattatatttgttgtgagctgagctctatctcaagtctcatatgattgttttttatgtaaaatagcactgattaaataaaaatattcagttgatcatattttgggaatattacaaaaattgataaaaagtggcttacctcaaaatttttcaaaaatgacacttgactatttcataaggactgtattgcacattatattgtcagtatatcatttcactaaactgttttcaaaatgatctttcattattggcaatggtcttaatcacagtaattactagagtagatgtgaactattggtcatcttattgatgtttgcacatataaaataaaaacacactcaatgcacctgagaaaaaaaatatatcacaagaaatagtcacactgaagacatatatggatttaatttttttgctgtgacactaatagccctccaattgctataattatgtcttagaaacaattcttacaaattcatagttttcaatagaaaacttttgcatatttcataaataaaacatataatccataggacatggtaagagcacatgatattctgatccttacacagatggctatttgaaggggtacaagctcccccacctataagaagggagtgtgacatctgtctagaaagacacaatagggctagcaagcaactgtcctgaaatacaggatgtaactgtttatactgattatctatcagatgatcgtttccatatcctgaccctgtgctgtgtgctcacaagtatggaggggatttccttggttttattgtgactcaccatatgctacattttaaaactataaattaagggttttggataaagctgcatggtctagcatctcttctgtccataggtttaatcctctcacaccacacgcaggagaaatctattatatctgatattaccttaaataaaagctaatgaactttttgtttaaatagaacacccatgggtactaaattatatgggagtaagaagttcttggatcctattaaatagaaagatgactatacataattaaaatgtagcatcttctagtgaaatggtaagttgagggtgagggtacagctcagtctataaaatactttccatgcaagcatgatgacctgcagtagttcatcagaatttacagtggggtgttatgtgtcccttaagccagcacttgggaggcagatacaggcatagacctgggcataatggtcctgctagcctagttaggaagactcaactagtgagaaccactgtttcaaatcaaagaccaaggcagacaacatctgagaaggaatagcacctgagattgtacagtggcctccacacacacacacatgtacagacatgttcagacacatacctgcacatgcagttgcatgtgcgtaagtgcatacatgaacacacacaaacacacacacaaagaaataacttgataaatgtttcagaagggaagagacatatttatttaaacatttatagactttacacatgtattaaaattcatgtggcagccagacatatatacaatctgaacaattcttgccttcatatataatagctaaaaacaaagttgcaacaataggctttggtatttgtattttctaattgattctatagtgtgatgattaaaatatttataattctaatgttcagtaatagattttatagaatactacatacaatataatgtattattttcttatgtggatagtacttatcaataaacttactaataagttaaactttaaaatcaaattatagttttaccacatcttattttatcacttgtgaggtatttttcttttctgttgtttattttgctaaggattattttatccaagtagtttatatgtaagaagaatgtcactcaaatatgttcttaaagattaaaagtaaagactgagagtcacaagccaaaggtcttccatattgggtaccctcaaatatctgaagacatattataaaataggtaatggtatatactaaaaggttaatacattcctacaagtttagtatgtccctcaactccatctggtacattggtaatttccaattaaaaatgaaacttgaagagtagtggctaagaattctacatttagattagataaaaataaccttgctttgtatacatactttccttttgagttttttttttttttttttttttttactattttagcactagtgctcaatgctgaccatgacttttgagacgttgtaagcatattccacatgtacacccaataagctttcatctatactgtttatatgatctataaatgctcaaataaggaatagatttcctgtgtttccctgacatgtttatttttgctgcctgtgtttattattaatttattatgtaacagtcattctactcagattttttactctatttaatacttgctctagcttttctccagcctcataaatgaagggtcaaaggcacactaaagattacacacatttaaaaagatcagttatttctaccaaagatacatagatgaaaaaatatgtcatctgaaaacacatgccaatttccactgttaaaatggtggatgtcttactactactgtgacagtacaggcgttgtctgtcttaaaagccagatgaatgctaatgacaccaacaagaccccatcattagaaatctttgtactttgaaaagaaatttaggactctttcctcctccaattatattcaggaattttgtcaggggatctctccaggtactatatctgtctaaatttcagcatttagaattgtgctcattttttccttaattgccaaatggttttataaaaattgttatccaatgtcgaagttaagggcttgtatccttcttctttgcttcactttccaacatactaaggtcttaacagatatgtggaaaattaacctttcctgagtttgtaaactatgatttggggtagcaggttgtgcatgtgtttaaatccatccttggttctcttttgagtgttaaagagccactcgaatatgcccaagattttgcaagattcctagaaagattattgttctctcatggccaccctttgtttcaggtgagagagcatgttagaaagtttatagagaaaacggtgtgagccacacagatgagattgggaactgtaattaggacaatgcagacttcatatgttgctgtatggtaatccgtataaatacactttaaccgaggtctcctttgagttaagaggattcaataccactgtcatcataaagggaaacattggaataatggcacttcttgaaatagctttttttttaaaaaaaaaaaaaaggttctttttaatctaaagtgcatacagaatgagacaccattagtgtcacagatgctaattttcacaagcagtgactgaagtggcattcttcccatttgcatttgatcccggcaatgatgagaggtgatgagttgattataagctgttttcgctgcactgcccgctgtgcaaatttatgctcctagacagggatgacacatagttgtggcattaaagagatgcctgcattgcttttttttccccccaaggctcttaaaatgcactttaacccttatttagccaggtataggaaagtggagactctatcaggacccggtacttacttgagacaagatacttgcatacagagcctatgtcctttgaatgttttgttaattcttttttttttttaaattaggtaatttcttcatttacatttccagtgctatcccaaagtcccccatgccctcccatcccccctgctcccctacctacccactcccacttcttggccctggcattccccttcaataaaaatttgatcatattatccccctaacccttcccagatacacagcacatatatttgcccaatgttagcattcagaattgtggggttttttttcttactggtcaaatataattatgtgtatgtttcttttaataacccaccaagttcaacttgtgttgaccatatattcatggaattgggatcatccactggagtttagttgacctatcggggcacacctttgaggaaaaagaactctctctcctttcctccggatgttagcacctgtcaatagttcctccaggtgggagcttgtgagactccacctaccatgctggaaggttgactaccttaatctcctgcagatcttgcatattcaaatgcaggtgctgtgagttaatggagcagggattctgtcctggccagaagatactctttggctctcttcttccctaacctgactcatgataacattctactctgtcttccataatggctcccagagctatgtgggtgggtggatacagaggtcccttttaggattgaactatcctctgccacgtattctctgcaaattgatcagatatgattttctgcattaactaccacccacactgcagaaaggtaactctttgatgaagaatgagagctgtaccaatctattgctataaagataaccatctagaagacagttcactacgatgcttactaaacaaaacaggatattcagggtaccactgtggcctgtgaactattcgagtatgggctcttgagtagatttataccaccagatgtgaatttcctctttaaaatcaagcctcaaatacaatcataaaacagtttgttacccaacccttgcaactttccatctctccttctctatttctctctgtctgtctttgtctttgtctctgtctctgtgtgtgtctctctctctcactctgtgtgtgtgtgtgtgtgtgtgtgtgtgtgtgtgtgtgtgtgtatacacctaacatttgtgcccatattgcacctacggacatacttgaccatgctgttcaataatatacctcatgaggctcacagctgggtagattgttgaaaagcccctatcccatagcatacataatccctcccagtattatgagaggtagctagtagagaggaagattcctggtgagtggcatatttatttttcaataccctttgaccaaacttgtggtgtctacaacaatagggtcatatcattaagttctggtagacaaacaagaactctagtgtttggctggtgggtaacagtaactctcctgatcaacaactcaaggaatgtattccacaccaggttccattaactttaaaaatccttccaaagcctcgatgacatagcactatattccgttaatttatagagagcagtgtaattctgtacacgtgaagtatttcacccaaggttaagaaaggtttgaatgttacataacagcgtttctataaccagatctgtactctactgttgctgcagtttctttttggattaaattttaatatattcatttagataaattcagtccactgtttagtgtttcaaataataggagttgaaaaactatggtttcatgaagggaaggagtatgaatgtgctgtggacaagacttagaatctgtcatctctttggacagatgacatccctttcaatgtagtcacactttaaatgcagcaaacactaagactactaatatcctatactatccttttattcaacttgtgtctatattctaagaaatggctcaagtttactgttcactggttcaaaggaatcacccataatttatacccaacttttggagggcttttctctcttccttcaaaatacattaatttgatggatgaattcataactcattcaattaactgttaaaatgattaaaattattagctgtttttaatgaagaatattctttccagcaaatcactaacttgttttagattttcccatcttatagaatgtaaatccaaaaccaaaatttaatctcaagcaagtagaaaaactttggtgccaaatatattgccaatatttagaaagtactaagtcagcatgcagaaaaatccaaagatagtgactgaagagaatgtggcttccccttggtataacactgaatattttatatcctataggaagaatgaagagacactacccggactactaacacactttgtcttttaaaactcgacttacttaaccatttgtctcttgtctttccctggtttagagaaaaaaatgacttcattatccacagggaatgtattttcaaacaatggaaccaagtgcataaacaatatatctaaatttccagatcatatctcgtcaaagtgaggcatttctccttatttgctaatattaagaattcaagtggagttttagaaataacccattcacattcagttcttaggagaaaaaaaaagccatcctccattaaaaagaaggggtgctttgaaactgtctgcggtggtagttgtggtgattcctatatacaggaagaaagcttctgttactacagttagattcaccttatctgaaattaacatgggggaggcttgctttctcaggaggtctgccagagaagaccctgtcacagagcctgtagctttgtccagtggatggatgccccatgttttctgtgcattttgctccaggatctctttctgtcttgctgacaacctcctataaagaatccagtgggattttattaagaaacaccccaatgattacatcatttagttgatggtctctatgaagttcttcacacacagttaccttctgaactcctcaagttagaagacagagggcaacacagtttagccactcacagtcaaagagctcccaccaaagtagaagtgaggatttgattttcagctccttctttcttccagctatcttcgatgccaatcttctgatagatgctccatgcttgacctgcatctggctgtcctgcacgcttccctgttcccacaccctcctgcccacttcaaactctcatcttttctcatgcagatgcacatctgctataattcagtagcttccatgcggcaccatttaataataataatattacctattaggatcttcggaggtgctttacaaagataaccaacccactaatgtaccatctggtttagggggctcatagagacttctgttcctgatgctatgaacactcgctctgctgcttgtcgtccggaatgtgtccctgtattcatgaactcgtgcttacttgactacttagctgacatctcaagaaagtggtagaaatggttagctagcagaacagtaggcaacagggactagagtcacacccagctgggtttgaaggtatgagtttgattatttctgaaccagactgtgggtactttattaaaccttatttgagctttggggttgtgattggaagaggaggacatgttagagcctgtcatgtaggcgtgtaggttgttagcacatgtctacttcctggtttaactgtgttaagtagataatcttggcatcttttctaattttctaatccttatttcataactgtttcatttccttggatatagtttgtttcgccccaaccagctctcctgtcaagaacagaagatatatctaactcaagtttgtaccctttgacttgggaagaactcaagaaggattgaattcagtctttctgactctcagaccgcattggctttctttccttccttctttttctgactatcataaaaaaacatttatataatgcaaaattgtagtgatttttcagtatatgtgctctgagtgtggcatgactaatgggtaatattagtcatttatagaagtaacctacttcagagatgcctaacaacccattcatgataaagatctgggcaacacatgataaaaaacagagcaactgtttctaggattagagttcagtgaaacaaaacaataaacaaacagtccattataatgtatgagaaatgaaagaggacagtgtgactttgtagggagtattatacatatgcatgtatatacacacacacacacacacacacacacacatatatatatgtgtgtgtgtgtgtgtgtgtgtgtgtgtatgtgatttttgcttatatataatgtataaaatataaagtatatagtatgtagtatatggtatatgatatatatatgtatatatgtatatataattggaagcaagcatctcatttatctctgcagacttgctcacaaacaggacttgaaataatatttccagtcttgatgctaagttgactttaccattatccggcttcaactaaccaaactaggtcccagcactgttatgctgcatcatgtgccatttcttccaagggaaataattatttttttaaaaatatatttttaaagatttatttattttatttttgagtgcactgtagctgttttcagacacaccagaagaaggcattggatcccatttccactcaggcatatctatatttttaaatttatttatttaatgcatgtgtgtccacttcatacacatcagatccctttacagatagctgtgagccatcatgtgtttgctgggaattgaactcaggacctctggaagtacagtcggtgctcttaaccactgagccacctctccatccccgaaataattctttcattaatatggagtatgggttctttcttagagaagcctcgctcacagtaaagagatacttggcagtgctaacttttggtatccttgcttataagtgagtcaatatgaagtgacttctgcaagcttggccaaagccttggatctgacccagagactcacccactgtatctagtttcctaaaaagactggctgctgtcacttctgatagcttctttatgtaataaagtcaaaccaggaaataatgggctttatttctataattatgcagttttactatctagaataagatccaaggcagatttaaccaatataaaaccttactttacaagacacaatgattggaattagatatcaaccggagaacacactggaactgtataggggtagtccctggatattgtattgttgcagtggacattcttttgtaatgtgtatgcttaacttacatatgttctctattagaattgcatagccatcattttcctttggctcgaggatagcttttgtttgggttgtttaagttagggttactcaggattagggctacctcattattattacctcattattaatacccaccagttctaaggtagccattcacaatgaaacaaatgtttataatgtaagaaatataactccttcagaagtcaaggtaatactgttatgagacgtgacattgtaggccacagagtgctcatcagctcaactagtttttaatcactactatgtatccctcaatacactgaagtatacatgctgtcagatgtaaatttgcagtgagaaaaaaaagtttttataatggtagatttggttgtaataatacatgtatttggtaatgaagaatcccaatggtgtctttcaaaaagccctagctcccacgctagggtatttttacccacatattccttccctgtttgggattgcatatcatatatttaccacacataaacatgtctgttcttactaaggaaaaaaaaaaaacacgtttagactcctaaggctgtggcagcagttgctgcctgggaagagagtgtttataaggtttatgatattaactgcagcactcaacctcaggcagcataaagcatgcaaaaaagaactttctgtcagttttattatttctaaaaaggttccccttgaagcagaagagtgaccttgctctgctgagctgacatatgccactggattaatggcggagcttggctgaaggggagctcacagacacattacaactccagaagctgggctggcggtgaccattaatcagggccaccaaaatcatgcatcaaacccacccatttaaaagtagtaaaaatgactttaaaaaaactttttttttgagaattagcttattgtttgtcattacttctgttcaaggagatcactgaatgactaaaatattccttgaggagacctttagaaaggtcatttgttcccagaggccacctacagcagagtgtggttaaaatctaagggatgcatagggtgtttgtactcctgagtgtctgatggaaaattactggatggattcattctttccaagttaacttccaaacctttaactattattttatagcaatgagtactatgaattaacctgacttctttctgatgatacatgtaatagcaacatatattataatcagatattagtattattgtatattagtcatagtagtaacacatgagtgacaagtttgttagaggattctttaaaaacctaaagttcgagtcaacatatcaaatgatttaatatgtttaaaagtctcctaagcttggaagtgccatataccctttcgtcatattgattacgatttcattagaaattttcatagacttaccacttttaattattgaaaatattttttaaaaaaatgtctgaactattaacttctgaaatgtattgttccataaataagaatgtaaatgactcttatcctttttgaactttcttaatacaaaatttaacgttttgcttctgcgtcatacttctcatttagattagtgttgctttatatatactatggcatgatttcatttgcaagcagggcaagtggaaaaattagacacttattaagagaacgaaaaagaggtgttttagatgtatttaaaacttgggttgccatagcagagcaacaatatttgaagttcttctaaatattggttgtcttttcttaccagggtcttaaatattactttggttgttagaaatagagtatacaaaatattagaatgcagggcatctgtttttgaagtatacttatttgactaaatagttagaaggttataatcagtaatggcatgacgagttcatatatttggtcacagattaaaaatatcaaatttgtacaaaagttatcttttaaactaattggagaagaatgtattttttttaattagaaaattgaatccctacccatgggaggagatacagagacaaagtttggagcagaaactgaaggaaagactatccagtgactttcccacctggggatccatcccattatacagttaccaaacccagacactattgtggatgccaagaagtgcttgctgataggagcctgatatagctgcctcctgagaggctctgccagtgcctgacaaatacagaagtggatgctcatagggtccccaatggaggagctagagaaaggacccagggagctgaaggggtttgcagcctaataggaggaacacacaatatgaactaaccagtaccccctagagctcctagggactaaaccaccaatcaatgggtacacagagagggactcaaggcttcagcttcatatgtagctgcatatgtagccttgtgggatattaatgagaggagaggcccttggtcttgtgaaggctcggtgtcccagtgtagggaaatgccaggacagggaagcaggagtggttgggttagtgagcaaggggagggggaggggctgtgtgtggggggtttcggaggggaaatgaggaaaggggataaaatttgacatgtaaataaaaaatatctaataagaaagaaagaaagaaagaaagaaagaaagaaagaaagaaagaaagaaagaaagaataaaggatactggtgagagagagagagagagagagagagagagagagaaagaaagaaagaaagaaagaaagaaaggaaagaaagaaagaaagaaagaaagaaagaaagaaagaaagaaagaaaaaggaaggaattagaatcccttttctttgcacagcctttcctgtaccatggtgaatagaaactaagattgataatgagaaagttgccagaggcaatttttagcttttggtaagggtgatagatatgtaagcccagttaccttggctcctcatgtgttccctcctgcatcctacatccttccaagcactacctgtatactgtacatgacctgtacacttaaaagttcttgctagttttaagctagagatattattgtctacccaggccattaaaaaatctagtgaaataacaatgttccaaattgaaaaagattagtcattaaaatgattgtgtccatctgacaatagcttttttgtcctgcaacagctgaagaggagttacagttgacattagtcacatttttgtcttccagaagtatttttcaaatataataaatagttacccccaccaccttttcttattttatcattttaaagcaacactacctttggctttggtgatttacagagtatctcagaaaatagctacagaatcttagaattaaaaaaaaaaaaactttgaagcaacttaaaattctgttggtttgagatcatttcatgtccaaacttttgatgacttactcttcacaataagattataggtatgggcctagacatgcatacaagatattattaagattgaatatttttatgataatatgtgtggtttcccatgtatatatgtgcacatagatgtggaggctggaaaagaaactttattgttcttggaaactgcatatgcctcatttgggacagggtctctggtctgattatcactcatcagcctgaactgcatggccagcaagctccagacatccttcagtttctgcctccctggtgctgggtgtggcactgcacctgatatttttaatgggttagaggaatcaaacatccttatgcttacaaggaaagagcaatattcaccattgagcaatattgctacttttaatgtttattgtttcatttatattttatagaacttaaaaacattccttatagtaaatttttgtcctatgatactttgtatttgaaaaatatatttagagcatatcaatgcattacttctgagctcccttcaactaacatggactcaaataatttttactgaattctagaagtgttacatgactttcagtctttagttgcagtataaatggaacatagtggagtaccatagaaaggaacaattgagaattcttaaatactcaagccttttgactctgaaatgtgtttaatgccctacgtcagctgttgtaagtatcacttttacattggctattttcagttattattgaacttcctgcccccaccccactgtgactctgaaatagtttcaatctgcagaaaagtttagtgccccataaaattctaaaagtaaagtttccgtatgagaaatctcagcaagatttagaaatgaatgatagcattggggtgtgaacattctgtccatgttttgcagttgacgtgaagctaatgaggtagagaaagagccagttgacttgggttcctagaagccacacccaccactgagaatattcataccgctgctttgtgttctgctttgttttggtgatgtgatcattttatttagctccgagtcacctttatacaaggatgtagtgtgagtgtggaggcactaactgttgactctgcagttcttgttgcttttttagcttgaagttccctggcacctcacagtctgtcttccacagacaccgcatggtgctgtgactatttaacactgaggcaatcctaacaggttattttcagtgagttaaatgtgatttttcactctccaacatcttagcacctgagtcagccaggacaattaaatcctcgaatgcttttggataaagggtgacagacgtgttgaggtttaacgttttataatacaatgttaatggcgaactcaaatggaattttgatctgaagagtggatactaacaaatgtcttatgagtaatgtttagatgtgagaacttgttggcagtgagtgtatatataacttctaatttgccaggatacttcaaaatactgtgggtgtctgattcacatttgcaaatattttctttgaaatagattgacacttctaccagtgccttgctcattttttaaaaatttattctttaatcttttttttacagtccagactttatccccctcctggtccaccctctgacagttccatgtcccatatctcctccacctgtctctatgagaatgtccccctccagcatccacccctcccaaccaggcctccctactccttggggcctcaggtctctcaagggttaggtgcatcttctctcactgaggccacaccaggcagttatctgctgtataagtgtgtgtgttggtgtgtggggagggctcatatcagctggtgtatgtggtggctcagggtctgagagatctcgggggtccagattaattgagactgctggtcttcttatagattcctcctcctcctaaaaggggcctatcatgattactctccaaaaagacttgctccatttttaaagtcatagtgtacagagactttatttgacaactctacaagttggtggctggataagaaagaaaagtaaggtcaaatctcctggttttggtcaaaagcttgattcatatttaaaaaaaaaaagactccacagttttctttcatgttcatagtacaaacaggcaaatggtttaggaagcttacttagctccatcatcctgttcccttcagagaactaaatcctcttcacagcattgaccatgttcctatatctctgtagtaatgaaaatgcacacaggtagtcaggagctctttaaacacagaacattcctcaatatggctcctcatagagattttcaacatacatccttgtaagcttaaggacatttgctccccaaatccactaaaaaacgttgggtgcagtgccccaccctgcactgaggaggcagaggctgaagctggagcttgctggccggccagttcaacctgattagtgaccatcaggccagagacagacgagcgttctacttctatcctttgcccctgcccctatgcctacacacacttctccccttgccctctcccttccctttgaatatcatctcatgtgagcccatgcagtgctttagtcacgaacatgttctggttgcttctctttcagtacatattgatagttattttctatatctagtattatagtagagactggcaaaatagtaattttatgatttcatcaactttaaaactagcatatataagcacaatatgtaaacattcagaataacttcccatgatcaattgttcaattaattcggaaatacatttcattcagaaaagggacattattgtcttttatttttgtctgttctcaaaatgctgctattatatttcccaagacaaacactgatatttctctccagtatgatgataaatcagtggattttgacatgttaagatatactgaaatgatctcacagtatattacatgtactacttccattaaaactaaaatagtatgctttgggctacaatctatccaaacactaaaatccttctgtatagccccctagttatttggaaggtgtgtctgtggtttgacaaaccaccaggcatacaggtgtgtgctagggtcgaatttgtgaactagagttgacccaaggctgggttgtcattgttctggacctttatatgtgtgacctttaagcattttattttatatctgcagtgactttattataatcccgatgatcttgacttaaatgatactgattttaattgttttcagtgttaacatgtgtgtcagtccgactaaccacgatgatggcaaaaggttaagattcagtttgccactacattgtccttgcagtacttctgtgtacagactgacacgttcctttgttttaaatgacttgtaataagcttttccttaagcaatccactcaatttagagttaggtagatgtgtttcatttgaaccttaaggtttagggattttttattttgattgaatttgagaaagttttgcacagttttgtattcaaatctatgaaacaacacatattcatcatttctttcttccacacccctcacttctttttatttgtatgtctttgaaagaaagcctgtatttgccttcatgagatttacagaatcttttttcacttacacaaatggtaattcattctctttggtattatctctttcactgtatgctagtgaattctctttccattgaactagggaaaaacaaatttcagggtttttttctttaatataaatatagactactaatttagcatccttttgatgagtgttgggatttaccggtttctgggtaaaatattacaatgaatgtatagtacattcatatgttagtattcatattcatatgttagcatattcacaagtcattctggcattgacatttagaaatgtgattgctatgacaaaatacaaatatatatgaaaacttaccagatgttgccaaatttccctccacagatgttgtgccattttacaagtgatttactaaatatattacaagggttgtatacttcatttagctggggtggagctgggattgaacatagagccttgcacatagatgcaaagtatgtgttctatttttgagttacactccaagcccttgtatatacttacacacaatgtatagggcaagcatgatctaatgccactattatcaaatgttgcttacattttgaattgcttttttattcagggcgcttttcccagagacagttctttgttcatgcaattgcttgatcttgatcagagcctttgtcaccggctagtgtctgcagaatgatcacactgtacacatttgtgaatattcaaacatgttctcttttattaaggactactatgtaggaagcaggccttgcttcctcataattccccttttcacgataaaccttgacagtagaaattataaatccatttcttgtccatacctcatagtagacattagctcctttctgacataagctataacctataaatatattatgaaaccatcttctcagaaagtaactaacttttggagtggataatgaaatatgctaagagcccttctcaataagaactgaaatttacttcttagagtatctcagcgtggacagactgactcctcataagagcccttctcaataagaactgaaatttacttcttagaggatctcagggtggacagaccgactcctcagcctttaggttgctgaggaattactattgataggactgacaagacccaaagtagcagggttttttttttctttattttttttatcttttaaaatcactattcccatatctgcttttctttattggtataatggaggaagaattaattttaaaaggcggtggctattgattacttaatggaataatatagtgtagagaaatgctgaagtgaatctaccttgtgccctcccgtgcagcaggccccattatccagcagtgggaagcattctgtagctctcattaatatgcaagaggtaccatccgactgggtataggctactgaactgccacaggtctaggttacaataggccataagaatgtcccgagtatacaaccgagtaataactgtccttgatagattcatttgtgagcaggacaatagttttctcacttctctctgatctttgagtcctgatggcctaatggaaaatgcccacaaggcaaggtgaagtgatccactctggatttatgtcttgttccgttagctctgtatgagatggcgtggtagtttccactgtggaacacactttcagttaccttgtctctactctcattacaaacaaaaagaactgggagctagttcagcaagggaggcaagtcagcaaagggcatttttttctacaacatcatcattctttgggcaatgttctagagcacaacatctaataggctagctatgtgtcacgtgtctagggtcttcttatttcaactcaatttaaagaattttaatggaagatggtggagagagatgtgtctaagaatgatcccaaggacaagccttctctggcaaagaatttttaaagtgagagataagttctgagtggacaataataaattctataggctactgactactgctattaatcaatcctattttttttttcaaattactaggttaccttttcagtaaaatctaccaatttctaaaacatatcattttgaaatgagtacaatccttaggacaagctatcttttttagatttataggtacacacacacacacacacacacacacacacacacacacaattagatacccaccaccctaaacaatgaataaaattaaatagtgagaaagtcaattttttgactcagtgattttgaagaattttgaaaatggttcaggagaaccatttaactttgaagtatctcaggtttatttataatcaccaacctagactgcattgcataagaataatccggcattgtaacatgtggggtgtagggaactcgacctgcataatgggggaagggattaggatctcattgtgattccgtgggaaatgtggagagattccgtttgcctctccatcttacactgtgcacggctacatgttcagtttattaacatgtccacctgtatgcctttctttctgataactgacagagaatttaaagttaacagaatgtattagtgggaagtgaacttgtgttaattttgtttttcagtaagcttatctgaggaagcagaagaacaattactcagacctttgcttgttttcattgttgcgttttactggttgcccactttgttggtaaatgctgcctgtcctttcctagtgcaaataacttagtgcttagcttacctaaagaaggctcagtttagaattctcataggtttcaggtgcttgggtcaagagcctaaggaagtactgtaaataatgtttttaaataagcacggtcttaaccactattacacaaatcaaaggaggatatttttagaaatttttagtataaaatatgaataataaatatttatatatccaatggcttttgatggctggaaggacttttaatagttttccatattcaaaagacatttctgagaagctataataaatttattgctttcagttatgaaagtcgcaaaccttaagtttcttttccttttccaattttacagcgcagcagcagttttgggaattttgaccgttttcggaataattccgtatcaaaatctgatgactcaattgaggttggtattttattttatctccatgaatattatgacagtatattataaaggtttataatgtaaaaggataatactatttttctgagttaggtaaggacattaaatacattttcaagtcatgtacacttatacagaattttgaaatagatggacaatatttagggcctagtaccacattgggcattaaggtaaaacagctatttaaaaagcttactcgatatttgggcagaataataatttcaagttagttatactttgaagatagttatgattcaaagttacattgacagctccaagtcccctgagcatttccatgctgaagcaatattcttgcctgagttgatagcatgccaggtagccaaatgggcttgatggtcattctgataagaggagcatgtagctacaccactgaactctgatacttctagtgtacacagaaaataccttactggtcaccgtaacatgcatatttatgaactaaacacactttgtgtatgtcttaacagtaaagtgtgctttaacattaaattttgtatataatgataatagcagtaccagcgacagatatattgaaaggagtgcttgacatgaaggaagtgtagtgttgccagttaggaattgttggtgtttcaatttatgatgaaggtatatatgcattcgctgatcctaattcctttttctactacagagttatcaaatgataaaggcagagataaacctctgactgtgatgcctgaccttctgttataccaccttatttactaggagccatttcctatgagtgactaaagaaaggcacagtagctagttaagtaacagaggagggttgcacactcagaaaactaagtatgtgacacatattcattattaaacccaaccctaaacctgttcctgacccagtgaattcactaatagtttcttttagatgaataatttatataaatctcacaaacagaagaatacacacacacacacacacatatgtttttatttcagcaaggagtatactaaatatagtaaattaaaataacatttcatatattattatttcttaatatatccattagtgtatgcctatatgtagtatatgttttatttatctacataatagatagatagatgatagatagatagatagatagatagataaagtcattacatacaaacacattcacacatacacacacacacacgcacacacactgacttagtttttttttttatgctgttgtgataaaatatgctgttaagaggaagtgtagacaggatttttttttttcatagtacagttaaggattacagtccatcacgttggagaagtcagtgctgtgagatcttgaagcagcaggccacgtcacactcatagtcaagaagctgagaacagtggatgcaggctgctgttcagcttcctttctccgtttatcaagtccacccagggaatggtggctagagtgcgtggctcctcccattccagttacgtaatcagaatcatccttcacaaacactcacagattcaattcctaagtgattgttgatctatccagattgactataaaacctagacactgcaaccatgttttacaacctatatatttaatggacaactatattaattatatacatactcacataaacatgtgtataaccacttgtctatacatgtgtgtatatacacgtgtgtatacacagaggggaacttacttgtatgactgatttcacttcgtgttttgcattagcttttacctctctgtaaccatacactgctgtattctgctgctacttagtttttaataaacctatgaacgttcctcaggctcattcactgtcaatggagtaaggaacaatggctttgtcactcgttaaagcatttagcagagctgataaagttaatttctcatttttcagaaacccagcaccaattcttcatccttttcacagtcatctacaaaatggcaggctttttatttggtactccagagtattgtagcaatgggagatggaaatgcctgcttcctaatgcccacaaagaaataacactttgaaagatcatgacaacagagctgtaaattctacacgaaaaatgtagttaaggctatggagaacttcacagacaagaaaactaattcaaaatatataaaacagtttctctgaagcttctacaaacaatgaaaggaaaatgaggaagtatttgtattgcattacttgaagttttgataatagtatcaatatcagttgtaactaaatgacatgtacttcagtgactaaaataagtttacagttaaaaccaagtttaaacataggaaagaggaaggagaaggccaagtaaacttttaaagggcttcccaaatcttttttattctgatattttgaactaagcaaagactctttgcctttgtaaccttgaatgtaaaaattaataatgtgcaatgagggcttaaattggctgtccattcatatttatcatatgcaatttggggtaagatatgaggcaaaatataatgttgattaataatgatgttaactatgtgcttaaactctcatattaaaatattcatgctcactaaacagacgtttcccatcattttttatgttcgggtatgaatggctgtccaaccttcaagcatggtggatagtatttaagcagatgaccttcacagttcattgtttccacatctgatgtatcaagaacatctaatccaaatatgtcctccagcggaggtggaaaaactgcctcaaatttctacatcaggaatttgatttctttaaaggttaccgagcaccagttaatgtgcttggaaatattcctgagactagaatgaagcacacagaggaagcctttactctgtagagcatgtgacatgtgagaaatgcagagaggaattcaatgagcaaaacattatcaaataaaataagagcagagatgaatactcaggtaaaacaaacgagaagtgtggacagacatggagagggaccaatcagatgccttctttcctgtaccatgcattaaatggaaacttggacagctaaaaaaaaaaaaaatacatctgtggcttccaggagaagccaacacaaaagcaagtccaaaccttggtgataaacagatgaaattgaagagatgcttaatcatggcaatatttgattaccaagtcatcatacatctgtgagtcagaatcaccacaaatgacttgaacaaactgccctcaaatactgtgtgtttttattttaaaacgctgttttgaaatctgataagtagggaagaataaattcataaagatatgtttgttatatcatatagattctatatgacataaacacatattttagcaacataatattgatttaagttaatgctaattttgtgattaaactttaataacctttaagatcactaccaagaagtttcccaccataaattgtactgtatcttttatgttatgttgctgagcttagcaaggatacaccaatacttatattttattctgagtcagaggagaaatcactgttttaaggagattgctaaggagcaccaggtaacagtaacccaaataaaaaacttaattagtaccaggtatgcaatacatgaacacatttcttcattaatgaattgagccaggtaatggttactgttacttaatgtgaaaatgtgtatgcatacatgttgcatgaaagcattgtagaattcaactgaattagttaacttgacaacttctttaaaactaactttgaccatgccaatctgattgagacccaggaggctgttctaacactcttccctcacaggtgggggttataggctttcgattcaatgttctccactctatagatctgtaaacacaggatacctgatggttgcttctgttttgcttatctcaaagatgagaactaaaatggttgtttgatagagctattaaaccataaatgaacaacagatttcacttgtaaaggtgagaactttcaatgaagttatgcaggcagcctgttgaacaatatgtgttatacccagagggtatactgcacaagaacaaaacatttcaacttggattctgcctaaagaggttgttgatcagcgctcttcaggttggacatagagtgcagatgtagctagaactcttgcttaacatgtgcagtccccagcactggaaaacacttgactcaaaaacatgatcctttcttctttactattttgacttttgtaaaaaattctctaccaggtccatgacagggaactgacaaatggaagtgaagaacaaagcaagacttcaagcagtggaggaagtctaggtaaaaaagtgagggctatttcatggacaatgaagaaaaaagtaggaaaaaaatacatcaaagctctttctgaggaaaaagtaagtatactttgtcatatgtatatgtgtatgttaaaaatattcaataggctctttctctagacctagattatttggtgttttatgaagcacttagactttttttccttcacctataagcttttttgttccttcacaaagtgtgtttgtgcacatgcatactgtgaagtggggcagatatcagagaacaacatcccacagtatgttctctttgcatatctacacaagttccttggatcaaattcaagtcctcaggcttgcacagcaagtagctttaccactgagccatcggaatggcccatttctatgattcttaaaggctcattattcacatttttaaaaggagacaaagcccacatcgagctgtgaagagaagtgcattgtttaagttgggacacatgtctgtacttcatttctttttattgcaaaataatatgccgttttataaataatctacatttcttcacatcgactgatgaatatttggactttttccactttggatacattgtgagtaattttgttgtaaatatttgcacgtgactcttgctatgaagatacttttgtttctttttgacatatggtgattctactactaatattttgagtcactggccactgtttgctcatatgctgcatatgttacatctcccatatcagtgaatgagtagcctcttctacatcacgtcagcctgaggttttaagtatcggccattagtgaagatgaagtaaactcgcgctaccatttttattataaatgaaagatgctgttatcttttaatgtggttgttggttatagcgatttatctctagagaaggatctatttaaatattttgtctgattttaatattctgttgctatcatttattaagctctcactgttcacataattctcaatgagtcttatgtatgtgattctaaatgcatattttatcattctgtgaattgtattttcatttttatagtattatttgaatctcaaatgtttataatcttataatagtacagtttttcttttttattatttggctttggaatcatacttgaactattgcttaacacagtatgatgaagattacttctgtattttctcctaatggcttggtaattttagctcttcaattataatgcatgattcattttgggttagatattctatgttgtggctcagaggagtaaaaattatttatttttcttgtaaatacctagtggactcaacttcatttgttgaagactcttctttccccgtcatacattgtcaaagtcagctgaccatcatacacaatgttgtcctaaacagagttcatacaaataaagtttatatatagactttcagtctataattttaatttgtaagtcttttgctcattttctctttccagtgctttcctggtttaattctgaccctagtattctatcacagtaacatctttggattgccaaacacaatgtcactttactttagctatagacacaagtggtaatatgctgacatagaaaatattctcttggttgctttgagcattttttctctttcacacagttctttttggtttttctctgttgcagtctctctgacaatgctgctgcttctttttttctttttttctttctcctttgaaatggggtttctctgtatagctctagctgtcctgcaactcactatgtagacctggcttgcctagaacccaaagatctgcctgtctctgtctcccaagttctagggttaaagacatgttgcatcaccacaacacatctccaatgcttcttaaaatcctggaggctccactaaatatattctgtccttttctgtgattttagacatgtctattgttttccaaagtgtctctagaaaggacttcttcatttgattgctatattcaatcaaccaactgctcatttgatattctcacagaagatgttcaatagatatcacaacctttgcatatatcaaactttgaaattctcagcactcccactggaaaacaattattgctcacccattatttctagttccaaagaacaatattttcattcttctagatgcctaaacatgtaatttgaaaaaaaaatcacttcaaattctttttcctattctgaacactaactaatcaaaatattgtcctgttcctaatatccaaagaatatttgaaactattcttttctattcaaacctatacctgacttagactaaggcactagcctcccctgccagcattaccacatcagccacctacattgtttctattatctctctaataagacccagtctgtgcaagaaagcctggagtgatgcctgaaaagcaggaccagaacatagtgggacccagattaaaacctcagtatatcttatttaacaatccctttatgatagagcaatgaaacaagtcccttttttggaactgacttccgataataagaaaatcaccaaggatttccaagggggcaatgcctgtgagctctaaagacaggttggtgcaaagggcaagccttgccatgacaaaggaagcctgggagctataaaaggaggtggggagaggaagattcactttctcttgtcaatccacttctgagaacattttggcagatgtgttgggaattcttgaaccaaagcttcccactagaatcaccttccttttcacccagaggagtcataactattatttacatgaattcagtccccaaggcagtgcaaggtctggcttcagtgtaaactcacaggtagatgtaaaggggaatgactggaacttctcaggtatattagtcatatttgctgttgctaatgacataacacaatagactggttattcacaaaaagccttattttggtcatgggttatgatcaaacagaaggaaccacatctcgtgatattcgttttggtgatagggtttcaacacagcagaagatgtcatgcagtgacaaatacaggattgtgtgtagatgttttagtgcccatccctttgctagtaaatccatcgatcccagtcatggaggctctgttctaatgacctcatccaatcaagaccacatcccaaaggccctgcctctaaacactgaagtcagataaagtttctcttttatgatactgcacagtggaaatcgaatgtacatgtgagttttgggggatgacaaacaaaacgaaatcctaacactcagtctctaacccccaaggctcacatgcttctcacaatacacatcacagtcagtaaggtgcagccccatggcaagaggtctgggtaccaccttcccatggccagcacagggctctaggatgttcttccttccctgccttgagagttaatatgcaatgccctcctttctttcactctactagcctgagtatcgaggttaattgtaagttcaggtttgtttctatctttccatttggcttagagatgtatctttagaagaaatatataagttgtattttctcataattgaggtcaacatattataaaagagtatcttcacacattttaggtggactctggggatttgttatcttagagttgaagtctttgaaattcaattctcctaaatcaactaaccctcctcattcttgcttgatttactagttctcttacattctatagcctatctccttcacagcacatatatgtatcataccaatgcttttatgttatgttattcattattattattattatatttccaactactttaatgacatataaactatagcttgtacagtatgcatggcccatttagactagaacataatttattagaggcaaagtccttttactctgttatcttgtttattaatgtatccacaaattttagaaaggtcacaagtacctatgctgtgctttataaacgttccctgaatgactaaatgaatgaagactagataaaagcagaaaatcaaactaagtctatgtatattatgagttttatcaatgctcagtagtgctcaaaaataagactattgaattacatagagatgagcattaagaaattcatagggctttgtccaaactttctaaaaatggaaaacatttgagatgttttcaaggaaatgcaatttgttttgaaattgtctgtcttttctaattttatgcaagatttggttttcacttgactaggtggcaagcacagtatgagatttgtaaagctccttagataaggctgactttagaattgcaaagtgagcatgttttattcatatctagtgatctggtagcgtgcaaataactgacatgaaacaaatgtgcagagtttaaagctgtagtaccagatctcaaaggattagtaatggtggcaaacagataagaagaacatgaaaagtaactgcactttatgcagaaaaagcattcatgctactccatctcacatttctgactaagtaatcttgatatgatattcatctttatttgcaaaaatatagaccattataattgcagttgaattccacaataagtaatgtctcatctagggaattttcccaagtatcctctaactgttttcctagaaaatgaactgaagattaatgaccctcatattttatgctgatgtattcatgagtgttttattgtttaaatgtatcttgcttgttgagtcagtgcacacagtgaacctgtctgtggaaaactgatctgcacacttaacctctgacaccttttctcctgaaggaggaagaaagtggagaggaagccctcccatatcggaacagtgatcccatgattggaacacatacagagaagatctcactcaaagccagcgactctatggacagtctttacagtgggcggagttcatcaagtaaggccaatgagtaagaggtgtcattgcagaaatggagcctgagataagctaattcaaaacagtgaatgctcactctgagggtgtttatcaaattagaaacaaagatccagatacatgacaatagagaagttggaaaggttagagccttgactatacatggacttactagtgattgtgatacatagcacaacatatttctgatgctatagcctacagggatctggtgcaatgcctcaaaaagttcatctatctatttatttatttattagatattttctttatatacatttcaaatgttatcccgaaagttccctataccctccctctgccccgtggaacaacaatatgaactaaccagtagcctcaaaaagttcttttaggtaacaaagtctgatataaaacttttatgctctgaagaacgtagtgttgtcttgattcaaaagacataacattatttgaaatagagaagtagacgtctattctttatttttctcccatgggccttctttgatttttttctttttgtttttgtctcttctttcctccctctctcattcccccactcatttctgtctgtctgtctttctttttgtctttctttctgcctgtctttctttctctatttgttctttctttcctttcttccttcctttcttccttccttcctttctttctttctttctttctttctttctttctttctttctttctttcttccttcctttttttttttttcaaaacagggtttctctgtgtagccctagctgtcctggaactcactctgtagagcaggctggcctcaaactaagaaatctgcctgcctttgcctcccaagtgctgggattaaaggtttgtgccaccactgcccagcccttccttccttcttccttccttcctttcttccttccttccttccttccttccttccttcctttctttctttctttctttctttctttctttctttctttctttctttccttctttctttcttttcctacttttctgcaaagtgcaggacatttgccttaattctgtcatttccatttactgttagtaagtagagactggtgcagtgaataatactgtgtgatagatacgtcaccagtggggtgggaaaggagattagcaggaactataagtgtggaatcaacactgctattagtctaagaaggacattacttaacatcagttacattttatgctacaacagttacaagaaagtactgacagtgctggtacctcatatattttatataagtaaactgttatctttcctccagtccagtatcttcaggactttgaaatgtcactgcaaagattattttccagttgtttttaaatcaagtacttctgttattcaaagatgactcacaaagaacagatgttttgaatattctcaattttcttcatattagctatacaatagctattttgttgtaaaaagctaatgcagactcattttaaaggatgaagtgcatgtgtgtgtgtgtcattcagatctcataagtatccagttctgctagaagttttcaaattcaaggttgtgatactgaatgtgagaattatatgattccaacataccatgcaaagccagcacccgtacactaatccagaagggaggtgtggggagatagtgtttcactcacatgctacatttctattcacacccaatgtggaacttacaggacttttgccttatttcaaaatccacggcagtgaaactgcagctcttgcctccttgagcagcaaaaggtcaacctgaaagaggaagtgaggagcctgtgagtgtgggagaaacagccaggcactttcactgccaacagctgtgacactacagaagggaagcaaaatggagcaagatggaatgctctctgtgtttgctttgctcactttttatttttctcaagtgaagttcaagatcagaagggaagggagaccagaaaataagcacccagacagtttggaggttcacacatgtgggcaactctcctctccacccctgtgcaaacaaaagtatcacacaaagatgtttataggcaaagatgtttatttcatatggtctttggcacacagtaaaaattctgggaaagactttttaatcacaattacataagttgtatggaactctgaaatgtcatgtgttgattacttatgatcaataacaacacaaaatgattaaactgtttctattgaattctttcatagtttccaactcggaaattatctgtcaaggtcaaagtttgaatctattctttgctccaacttagcaagtggagcattgattgtttaatgccctttaaggcagatcagatccaaatgaggagatattttgaaatgagatggtattggaataaggactatctagagtattcagactggcaagaaagcatcaaacctagcttacaagacagggtttccgaagggatgtgactgagaactgcataaggctggcatccgttgctccagtttgaggtaatggtacaggaagctaaaagccttggaagctacaaactgttaacctttactttgtcaggtggaataacaagctgttcagatggaacaagtaatcgggacagcttccgactggatgatgacagcccctactcagggccattctgtggccgggccaaagtgcacacagacttcacgccaagtccctatgacaccgactcccttaaaatcaaggtgggccaacattacatatgcttcctggtttatcaaacactagttgcatgatagattttagggactaacagaagttgccagtaaagatgtatgttctttcgatacagtaatttggactagctcatagcaggaagagtttgaacttagtatgaactggggtgtaaatctcctatcgactgtggctgttagcattagagaatacaaattctgcacttttttgaactctgcagctcttagacgtggccagctagatatgtccacctgatacatactagagtaaaacaatgaagcaaaagagggagagaggacaggaacgatctggcaggaagccaacagtcaaggctgtggggaaccagacttggctggttcttcctaagtgtgttgccatgagaaaccagaacttctttccctaatgataaccctttcctaaatttctccttaaaacaaattaccctcaactccgaggattcaaataacatgtacttatttcatcacagtttttttttttccaggcctaaacctagataggaatggctcagctgttttctgtacaacgatacccctcactgatattaggctgtcaaattaaactgtgagatcccctgagacaagaactccttctttaaggtcccatgatgttggtagaatacagtttctcatatctctctatgaaactctatccatgtggtactggggtgattctttgcagctctcagagaacatgataaagatcccacagttaatactgggaggaaactgactgggtctttgtctgtgtcagctggcagctttgatgaaatgtgcagatttaaaagatatgagatacaagaccttgaagttaaatatgataggaaaatcccagtaaagacttagcactcctagaaactcactagtgcttctggggaacttgctggtctccttggtggatggtagctggcttgccattccattctctcaagtacgaagtggaaatgccaagacctacacccagacagacatacatactatctcaaatcagagagaccatctttcaatcacactctattctaaatgactataacaagtgcaattgtgttttacatctatcgtacattcacagaccagcaggaaactagatatttaagcatagctttaaagggtagagccttaaaagcagcaaatactgatattgatcacatctgtgggggatgtaaagttacatctcaagtgaacaactatgactcttacaaataggcacttaattgcccagaaataaaattttttcatagagaaatattcctagaaaaatttttactgttgtaaataactgcagcctgtggccaaatatagtttttgatataaatatacaaaacactagttggcttggccataccaatgtgcctagttcatgtgtgtttgaaaactttaaaagttatggttgggatttttggtctacataatgtctcctattgatgctatcagacattttgggaaatcccagtgaggtcatcatgttacctgggaaatcatggtcccgatgtggagatcttagtccctttaataaaatgattttagaatggaatcaaaattaagggaaatttgattataatttacaaagaagaagtccagggcagcaagctataggtctcagcagctacagggaagaggcagaagattcggaacagagagagacacaccctttgagttagctctgtgtagaggtcacccatgaggcagacaagcaaccacatggtagagatgaacataagggaaagaatgaagctaaagtattagggaaagcacccgtagaggagagataagaagatgaaaaggcagagctctgcttttctaagtaattgagatgggtctgggcaattgtctgcagtcctatactagggttgatatctcagagaagtcagaatagtctagctcattattccccttttttccttgatcttggcttaaaatcaacccacttcccaagggtggtcctatgactaaatgattggccagaccaaagagattaactcttttatattctgattagattggaatgttagggctctatccctgccaaagaaatagctttctctatgggtctcacatgtcacagttcagtgctaatgtgacacatacagggagagagtcatcagtacctcaagaaccaagctgcatacctggctgcatgagtacttctgttacatatttagtaaatcttatactttcattatgcggagaaaacagtttacattacttaatttgtactgtaaatgagttgtgtcatatgagccaaaaccatggacagagtctaccgtttctctcttccctttctcccctttaagaaatcacactgaatgatgctttcattctttagtcctgtattgattgaggagggtaaaataaaaatctgaccctatcattaactttgttcaggctcttgagaattaatgtaatgtcaacatttctactcatgtaatgcttgaagcaataatctgataccctcatactatttacccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggagaagagagacccccccagactatccaggagtttttagagaggattccccttcaggttagtaaatctttggtctgtttggttttgttaaaaaggggatagaatagtggagaaagattgctaaaaatatatattatatttattatatattaaatctacattataatatatatttaaatctacattataatatatatttaaatatacattatataatatattatagtaaacctgatttcctagaacagttcttatttctcccttatcacttttattatgcaaggataagactttatgtagcaccctttgtactaaacctgaaaggtacttagcagccagtgacaacagagattaaagaagtggcaatgaaaaaaatatgcacacagagattctcatatatatatatatatatatatatatatatatatatatatagatatatatatatatatatattttatattattactcctgtatatgataggagataacaaaaatttttaaagtgagaatgattaagagaataggaagaatatagtgaaatctgagggactgggaagaaacatgacaagaagcttgaatttttgcatagagaaattgaaatgaactgcaaagaaaatgactgcaaagaagcacctccatagcaatctaagaaacactgatcactggagctgtagcgaccattcaggggacggtgtgttctgtaagaacgtcacgtgaacccatggccccaccgggaccccaatcatctgattataacccgatttctcttacattcatatattttaaaggaaataattcttgttaaatggtataatgcagcatacagtgcggtgggcaccgcagtctcattccattcacagtcttacatcccatttgtaaaatgaactcgtcagtcctttgataagctaagtaattcatcaggacagtataaatgatatgtttcctaattggtgtttctgagttactaagttactctcctatcaacacaatgacatactgcttaagttcctctatcgtacagtgcgatcctcccgggaggagatgcagtttgaatcccgcctgtacaacccacgggaaaacccctaaaggtgttgtactcaagaagccacagtgggttgtgtaagaatggacacttggctattctgcattcttctaaaatgcaatttttaaaaaggaattatcattcgtcccccttttttggttagaatgttgtaataagtctttccgggttgtaaagcctaattagtttgtctcttatttgcatgtgtttaaggctgagtcttcattttctcccctcccgccctctctctctccctccctccctccctccctctcccttcgttccctccctctttctttctttctttctttctttctttctttctttctttctttctttcattctttcccattacaaaatacgctgcagtacttggcacacccccaattctggggttggaggcttgactagatttaagtaatcatattcagttttagtaaccgaaataaagatattgaaagtatgatcaagtaaaatgggagaaatttttgaggaagcttataaaacattttaacttcactttgcatatcaatctgtcagaacaggcattatagaaataacacagatactttattatcagaagtctatgcatgttaaactaatatatgttgatgcaaatggcagacaaaaatccctactgaggaaaggaaatagtactatcttcaattctgagcctttcacctgtaattaaaattttgacttaaaaattaaacaagtctgtgattcactagatatataatacttttaatcagttaaaatgataaactccctttgtatacagaattctgtctgttttaagtttatttttactttttacatttatttattcagtgtgtgtgtgtgtgtgtgtgtgtgtgtaggtcagagaaaagttgcaagcatgaatctcttaccattttgtggtctggaacctaatttatttaggtcatcagactcagaggcaagcagtttccctactgatccagctcactgaagctcaagttaattttgaagccacactaagaaaataatgagagtcgttgttttcatgaccaagaaatcaaaaagagagtttggttcagaaatatttctgtaacttaatctattagaaatattctactggaaaacttttaaaatgttgtttgtgtcaacttaactatgtgtgaagtaaaagtgcccgctgggagagaagattcagccggtaaatggcccacaattgaccaccgttgtagattcccgtgattatttctgctctacatttgcccttctaaaggttaagactttacagttttttttttcctctcaaatgcccttgaatttgtttgtggtaaattagtgtaaataaaatggctttaggagaaagttccattcctgttttggttctcacaggcatgtctatacttcctttcaatttagagaaaataaatatttgagccctactcgtttacagatgatacctacttccctcctcctacaggaatacacttcaacacttctgcttaatggctatgagaccctggatgacttgaaggatatcaaagaaagtcatctcattgaattaaacattgcagatccagaagacagggcgaggctgctgtctgctgccgagagtctcctggatgaagaaagtaagtctacgtgtgcctactcgttctgtttcctcccatcatcacgccgtaatctaaacagtggaatcagtgagagcaaagcttcagcctcatttactaaaaatcatacatagcatcctttcctatagcatgggggtagttttacataatactgagtacagcactggccaaaatttataattagggtaaagacttcgagtatattcttaggaaaggatttacatgggtctcttgttttgattctgtcaacaaattaatttacacacaattggatgcctgcattctcaaagaccaagggacttagagacaaatatcctagtgacagcatgagccattagtaagtaatgccacacatgccttctgtggcacaacacagagcctggctctaagctaatgagccttccccaccgcacaggaaaattcatttcattaccatatagtcacatcctgtgggtgtttgtgttactcttcataaatgttataatagcttgcaaaaatattcagcgctcactcttattatcagagatggctctctgtatttgtaaatataaactgaagatgaaataataaatgcagattcatttatggctgagtacaaggtttgtaaaacagggcagctttcattttttacaactgcccattcagaacaccatttctattcaatctagtcaagcctccaaacccagagtttagggtgtgccaagtactgcagagttgttgtgtaaagaagaagaagaagaagaagaagaagaagaagaagaagaagaagaagaagaagaagaagaagaagaagaagaagaagctgcttcatccccaaatacatgcaaataagataaaagctaattaggctgcacagctatgtatgcatagttgttgttattgttgtgtgtacgggtgaacaataatcatagacggaagattcaggaagcaggtggaagttggaggaggaggggtggaaatgatgtgaatacaatgtatggaattatcaagagagaaaaagagagagagagagagaggaatctaacttcaaagcttaaaaataatttaaaccatccaatcaaacttctctttcaaaaatagtactaacagtagcttttcattactttcttcaaacatgtaaacatagtaaagttttatcccaaagtgtatacatttatttttgtcctgagtgctgttcccagctcagacagtgaacttccctatttaaggttagaacgtgaggcaggaagtgccttgtgtcttgaactcaagttcctagtgacttcaggcagtgaggattccagctcagtgtttgggaaacagtgctgggcttctaggcactgcaaaacacagctcagatagtgagcagggagggggtccagtgtagcacccaggcctcttgacttctttgatgagttatcctgtcctagatttcatgtgttctatcaagttgaagtgcagtcagtctatatttcatgtgcagtaggggttagtgtacttcttaagacactgtcttactgttttcatagttgcagccttgggtttgcacagatatttatcctttctcacatctctggcatacatgactaacccaatgcaagaagaaatgattgtaggcttgggtttttaaagttttatttctggggacacacagcttctttcacatcttgtcatttgagtccatgtctcctcactagactttgtgagtaaagaaactaactctgtagttttctcatgttgaccttgcatagtgatgtagtcaagaatctccaaaagagtgtgcacacgaagtacaaagagaagggtcatctctggatgtttgaaaatagttccattcaaaacatctatctttttcaatttcttactgatgaaaataaatgttgaagaagggaaacatgcagataaggaggagaggtggggcggtgatccaaggcagtgctagaaagcccagagctccatcctgcatttgcagcccagtaaatataaaaaaacaaatattttaaaatggaagttttctgttacttcatcaatatcctaaaagatattatttgagcatttgaactcagggagtgagcacaaattcagctcagcactcagtaggttgaggtaggaggatggagaatttaagatcagtttactttatacagattgctattggttttgagacgagagagagagagagagagagagagagaggagagagagagagaaataggaagagaaaaatgaaattgagagaaaaagagacagagacacagagagaaatggagaaactgagacacagagaaagagacagagacagagacagagaaacagaaagagagaaataaaattcatgttgaagaaaagtggcaatatcatcacctcaccctctgagagggaagaagctactgcaagctgtcttgcagcagggtttgtgacgtgaaaggcatgggttccagcaaacagtgttttcagggacaaacactattcagaaggaggcaacaaagggaagatggagtcacccatgtccactccacttctcattactgtctatgctagccagagaatgacttgcggaggtaacgatctgagagctggatgcaattttatcaacttctgaccccaaaatattacttagcaaggtagaaaaactaaagcatgaatagttaagtagatttcttgagcccatatatctgggacttagttctccacacctctgagatcatacatgctccagattttcctggtctctgaaaataaaagaccgttgtctagaaacattgtgtggcattcactgttagacatccacacaggacaaatcccagaactgacttccctgaataagaccgtagaacatagtgcttgaaagtcgagagatgctaattactcaataagagcctcttctggataagcagacacattaagactctatgttcagaagacaaactatagagaaatgcagatatgtcttgtgtcactttcaacagacaactgtgaaaggttattcttattttaaccttatggtataaagtaatgttagaatacacatgtcaaaaagatgcatttcgtgtgttaggcttctcctactgaaagctatttatcttctatgaagctgcttcacttaagaaataaaaaagaatggcatnnnnnnnnnnnnnnnnnnnnctctatttatttacatagaagctcattttacacgagactgtgattgcctcatgacagaatttatttgcctaggctttaaatacccagtatggagccaaacctattacagaaggaacatttagaaaataggtgctagggtatattgagcatggcaattattttccatatacaactggaatattgttttttatatcagttagtaagtcactcataactacttataggtgaatgcctccaagtcacctaaaagtttttaaagaaaatgtggagttggagagatggctcagtgcttaagagtgcttgctcctcaatcatgagatacgagattggatcagggcaaccaagcggggtggctcacaaacatttgtaaatccaactccaagggagcaggtgctctagagattccggccttcatgaatatcctcccacatacagacacacacacacagacacacacacacaaacagacacacacacacacagacacatacatacatacatacatacacacacatctttaaaaatgaaataaataacaggtaataaaactcaggcaaggtaaaatattctgaatgctgagaacaacccaatagttttagtctccggcatctttaacacacctaatctcaccaacatccccacatcaagtgtgttgcatgtgcatctctttccttcccagcaaacccggtgttttcctgactgtggtgaccactgttagcagactagtctagaaactgttcttggacacagcacaggcactaatgtcattaatttttaaactgccctacccctactctctcatgttgtttaaaagaacgtaacttttttatggcaaggcgaggaaattctagattggaaagtaactacagaataacaaaacaatgccagtctattcctaatgagtaaaactttttcccaatttctatcccttgaaaatgaaagtttcatgccagttgaggatttagggatattctaaagaggctttggggagatacaagcaaagaaagtctgagttcttacaaaaggggagaaaagagaaaaagttannnnnnnnnnnnnnnnnnnnttttggaattatgtttatgtgtcctaaaatgtgtctaccaaaataagttcaatggtccttagtgtaaaagggtgatagaaatatctttctttcttacattcagggctaattaaattttaaattgaaaaataatagtaacaaaataagccaacttcacagacttgctactctggatattttaggtacttgtaagttttgattttggtgccaagtgaggaggaagggtaaagggtgggttgtgtgccagctggttggcaccggctgtggtcacagcggctcctcattgctctaccacccccagttgtgccttcctgcctgcccaagtgcatgcagagcaaatgggagggccctgtcaggagctggaacacgagctgccagag

SEQ ID NO: 2030 - DNA, 1373 bp, Mus musculus
tgtattctgttgctgatgctcaaatctatggttccagatttctttcctagggtttctatctccagtgttgcctcactttgagttttctttattgtgtctacttccctttttaggtctagtatggttttgttcatttccatcacctgtttgtatgttttttcctctttttctgtaaggacttctacctgtttgattgtgttttcctgtttttctttaaggacttgtaactctttagcagtgttctcctgtatttctttaagtgatttattaaagtccttcttgatgtcctctaccatcatcatgagatatgcttttaaatctaggtctaggttttcgggtgtgttggggtgccctggactgggcgaagtgggagtgctgggttctgatgatggccataaaatcaggtggtgacccagtgggatcaatgagaacattaaatcgactgcagaaatggctgtggatcagaaaagccagggtgccgagcctgcaagaggtgaagcctgtgttaatagacccccaaggtggtgaggacacattgctttcttgtgtgaaattaaccaaatcccaaggaaagaaagatattgacatggccaccaagaaaagcaaaatcccgaatgctggaccacaatccctttctgcatccctcagtggaactagcgtttcaaatgcacacaacccggaagacccagtatctccttatgagattgaagttccagtgtgggggaacttgaaaccgttcccagaaaacccattctgggcaagcactgattttccaattggccaaggaggatactggggcagctgttcctcttgtcagcatcttcgtctcaaagcttcttacacagacatggatctcttaagtacatggcgcagcagcagttttgggaattttgaccgttttcggaataattccgtatcaaaatctgatgactcaattgaggtccatgacagggaactgacaaatggaagtgaagaacaaagcaagacttcaagcagtggaggaagtctaggtaaaaaagtgagggctatttcatggacaatgaagaaaaaagtaggaaaaaaatacatcaaagctctttctgaggaaaaagaggaagaaagtggagaggaagccctcccatatcggaacagtgatcccatgattggaacacatacagagaagatctcactcaaagccagcgactctatggacagtctttacagtgggcggagttcatcaagtggaataacaagctgttcagatggaacaagtaatcgggacagcttccgactggatgatgacagcccctactcagggccattctgtggccgggccaaagtgcacacagacttcacgccaagtccctatgacaccgactcccttaaaatcaagg

SEQ ID NO: 2031 - protein, 357 aa, Mus musculus
  VARIANT (1)...(357): Xaa = Any Amino Acid
DMLLNLGLGFRVCWGALDWAKWECWVLMMAIKSGGDPVGSMRTLNRLQKWLWIRKARVPSLQEVKPVLIDPQGGEDTLLSCVKLTKSQGKKDIDMATKKSKIPNAGPQSLSASLSGTSVSNAHNPEDPVSPYEIEVPVWGNLKPFPENPFWASTDFPIGQGGYWGSCSSCQHLRLKASYTDMDLLSTWRSSSFGNFDRFRNNSVSKSDDSIEVHDRELTNGSEEQSKTSSSGGSLGKKVRAISWTMKKKVGKKYIKALSEEKEEESGEEALPYRNSDPMIGTHTEKISLKASDSMDSLYSGRSSSSGITSCSDGTSNRDSFRLDDDSPYSGPFCGRAKVHTDFTPSPYDTDSLKIKX

SEQ ID NO: 2032 - DNA, 81098 bp, Homo sapiens
agtatttcatcttataattatattgttctcaaagatgatggcatgaagatcatatgaggcttttgattgttttaagaagtagacaatacacttaccctctcctatagctttacaactttgatgtagtttcaaatgatcaggcctgaaaaataatctggtcactcttgaatctgctataaatttttctgatgagtgaaaatagaaaggaaatagaaatgatcttgttcttcctgtttaagaatagcgtttctgaggaaaggaagctcatatatatctcttccatgaaattctactaattgcatttttcttcagtaggtagagacaggaaatcatggtctattgatcagtacaatctactttcctctttgcttctggggaataaagtatgaattaagcaggcaattttaatattatacacgaggtgtactatgttcagataaaagttaataacaaaatttataacaaagcacttctgtgcaaaatttagatcaatttgttctgtcagtattgtaatatggacagaattgcctttctgccaaatgaggcacgattcagtggtactgaataatattctaagtttaaaagttattttgaagatttttaataaaaacttgagcttcgactgttttatcctgtttataaagaatgaaaaggcaaactcttccacagaatactgtatttttgtgcttgtgagaagaatatgaaaatgtggagagagcacaatcacttacatgtaagaatgggcttcaatggaaaggcttcatctgtgtgtgttgctttcttcctactgtgtcattctgccatgtccctatgccaatctgaaaactttaaggtaggggtggtattgacaggaatcaatacctgctatatgtttcatatagttaggagctgagcaaataagataaatatgtccaaatgttttaaaaggcagggtgaaggaagagacttggagttaataaaaatgtgaaggaatgtagttggcaaaactagattttgtttaaatagctacatacacttaccaagaagatgcaaacctaaagagacaaagagatttgggagaaggatagaaaggatgtcaactaatgttttggataataaaaggtgaatggagagttggagcacgttgcaatctcagaagttgtagacaaggaggctgcaatgaaatgagtcagtgtgcatcacagaggccctgagaggctcagcctttgaaggcagcaaggaaactactttcttttctccacagcccagcagggcatggaaaggttagtatctgcagacctgaatagtctcaaagaaaagaactccagaaactgtcatttgagggtcttctgatgaaaaagtttccttggggtaggtgtggtgattcatgcttgtaatcccagcactttgggaggccaagcaggagaatttcttgagtccaggagttcaagaccagcctgggaagacagtgagaacccatctctacaagaaatagaaaataaaccagacattatggtgcatgtctgtaatcccagctagttaggagactgaggtgagaggattgcttgagcctgggagtttaaagctgtagtgagccatgattgtgccactgcattctagcctgggtggcagaggaagactttgtctcaaaaaaaaaaaaaaaaaagaaaaagaaaacaaaagacttaactgctacttgatcacctgacaagcccacccatttacatagaacttccagtcgggttttttcataccatgatctttagtaatgtatccagagagcacaatctccagacatatgacaacagcttaaatatgaaagactgaaatcaaagcaaacagaagaagtcagaataaaacaagataatgaagggaatagaaggaaaattgtaaaaatgataattaataacttcagaaagataatggaatatattccaagtatttgcttgttactatctagtgtttattatgtaccaggcacttttccaacaacaccataatagtgtctcttttcattctcatagcaatatctttcaagcattactgtcatgtgcactttatggaaaggctaaataacttgtcaagggcacccaggtaaatgacagagtcaggatttgaacctaggcagtgtggttaaagtccaccctcataaccattacatgtcactgcctttccaaaacttaagaacagaatgttatgaaaagtgaacaatcagaaagcatttctgcaaattaaaaatctagctaaagtaaaatatttattgtatttattatagtaattagtagaaaaagtaacggaattttcctggaaaacaaaaggtcaaataaatgaaatcagagagcaatataataaaatgagagtatcaatccagtatgttcaacattggactaatccgtttccagatggagagaacaaagagagatgaagaacttatcaagggaacataggcctaaagagaagtttttaaataacccatatcaacacacataatatgacattttaggatataccaaagattcgaagaaaatccagaggaaagaggcagagaaaaagaaagaaaaaacaggccatacacaacaaaacaggaatcacaatggcttctgcagacttctcaacactctgaaagctagaagacaattggagaagccttctaaatattgagaaaaaaatgatttccaggctagaattcgatttcaagtcaatatagcattcaaatgtgaaggatctaaaaggatgtaagtgccctttttctgttaaggagatatgtttctgcaaatgagagaacagacaaaaagaaacatgatgtgagacttagaccagagataattggaagtgattaaggagaaattccattctatcctcaacggagaacaactaaaccacattagaacacattagaacagaaaaaacatctaaagtgtttgagcatttgcaatgacaagtatgatgtttgaaattaaatatttgaaacaaatcacttgaaataattgtcagagtatttattggtgaaatattaacaatatatagagaaccaatcatataaaaagaaagacagttattaattccaaaaatgggcaaaagaggaacataaagcattaaacaatatttaactcagccatgaataatattatttataccatgataatgttaatagtgactaatgatttaacaaaataattataaggtagttgggaagtaagaagagtacaaaatcctcaaggataaaaaaaggaataaatagataatgcctaatgcataaatcaagaaaatatattatctagaaaaataaatctaaccaactagaaacattttttttttaaatattggaaggatcagaaaaagagttgaaataggaagtctaggaatagagaaggatgggagagggtgcttgtgttttctaacttttttagtgtaagcatttttatatttgcaaaactttaaatgacatttagaaatatagaaaagaacaatattgtagaaatgtgaagatgataatcacaatttggatttgatattgaggcaagcaaaatcacaaaattaagagcaaaagattgagggaataataaacgctctttagaaatagaaattggagagctaaacctccaactcgagcaaatggaatgtgcttatggtagtaactttacggacagatgccttatcaaaaacaggtgacttagtccatttgggctgctataataaaataccataaacttggggtagcttccaaacaacagaaattcatttctcacagtttagaggctgggaagtccatgatgaagacaccagcagatttctcttctggtgagggcctgtttcctgggtcatagatggcaccttcttgctatgtcttcacatggtggaaaagtgggagtgaagggatgtctctctagcctcttttataagggcactaatgcaatccataaaggctctgtccccatgacctaattctcccaaaagccctacctactattaccttccaccttgcgggtgagaattccaacatatgaattttgggaccacacaaacattcagaccaaggaacttcatagaaaggaatttcataaagtgtgcataagtctcatttgtgcttctactctgattacctacacccatttttgtaagcataaaattagagacaatgattattatcaagggtagaattgagggccaataagtgtctcaacaaggtagcttgggttggagaggggcctgaaatgcagatttgtccccatgatactgaatcttaattatagaaaagagctctggattggctgcagatttactggtttcaaatttttttacacatgtaatgattgaaccaactctcttttcaaccagaagccagcaactcaacattaccctccccctagcccttagcattcctgacccgaacagtcaaattaatcattcccattttatgccaggtatttaggtatgccaagacctacttatgacatagagtgatggttatgagctgaggctttggattgaatcctgactccaccacttcctagctgtgcaaactagacacgttaccaaaccccaccaggaagctgagaatgataatattagtaccagctcatgaagatttttgtgaagattatattgaaaatatttataaagcacacagcataatttctgttatgtaataaacactcaagatgacagtcattattattaatattattaacttgtagaataatattacttcatgaaaattacaacttttaatcataaatggattaaattttatcattatttgttatgccaaccacaatatggcccttatatgactttaaaaccacttagaaaggaaatacttataatttattgaagtaatctgagtaatttgcatttattttgaatcttaaactttatcagcctccctaatttttccagtcactttgaactgatactactcattcttggtacccagtcttctcttacattcaaacatcttgtaaggcatagatgtaatttatgaagttctttgtctcttcaaggcagttttatcctgtatgattctttaggttcaccattcatcttaggccattggtcccttctatttatcccaatgatctgtttcttctataactgagataacaagataatgtgttacattatctctttggaaatttaaaataagcagtaattttgccaggccaggctctctaagaggcttcccaagatatccagagtatgactagcaactctaaccactcagaaacatagtattttgagcacatcaagggtagatccttttctgtcaatacattctagttaaccactttggcagtatttaaatttgtaatgagaaatagcaatctcagattccaggtacttgatgtccatatgaatgctgcctttgtctcctatagacatatctacccaaggagccaaatcatcatttatgcatagagcttaaaataaaaacaaaggaaaatagttaaacacatattttgtttactgaaatccagctaaaatttgcatgatatgttcatctccatgcaatagattatcttgtctggagaattaagatactcaaagctcactaagctctcttttcctttaactcagcaacttgaaaggaaccttccagtatttgtctgtgttactgtcttttttctatttgaggtaaaatgaatttagattctccctaaccttcctaattatttagaagttgtttgggcatcacctcatccttgttagttgaatgtatgggaactcaggcaatgaaactcaggcagggtcttataaggagaagtcaacaggtggaatattaatttatcatgtagacttcaggtccgtttttagaagaaattaatcctggtgatagatatgcttgatttcacgtcttgttggaaatggcaaacctcagtagctcccatcttcttgccacttcctgttaatagaatcagaattttatcttcccctaatctccccaaaacatgagcttgtcacttcctggagcaggtcaccaggagaagcagaaaagtcactgcacagcttttcaattagtaacacattagaagggatttcaagagctgggtagggctgggtcccttagagaaaggaattagtaaacaggaactccagacatagaatgggtaagtgactttagagagttaggaaatataggagattcacaaggaagaaacggtccccccacttccttaactcctcccataggccagggggaatatccatcccgtcatttctcttaaactcccaaatccaaacaaggaggtgttgagatgtttaatccacctatggtaagaataagctagataactagaggagggtacaacaccaaggcccctctatatagcttggcaccaacatctgaattattaaatacagaattgcagagaacgtcatcagatggcaatgtgtacttatttcaggaaacactgagaaagaaagagtttttttttttgatattgtaggatctccacttccgtgaaaccccaaacaggtaggaacacaatatccccactcaacttctttgaataaaattctcttccctgtactatagaaagaagtctactctgagggggccaaaaagaagagaggaattatcaaggttaagttacttttatgattgactccttttcttaatcatagatgagtaaattctgcaggtttgaatggaatacagttcttttttctataaaatgattattcttacattaaatcttaatttcagagttgggttctgtgatgacaaccttattttgcttattttcaaattcttgaaattggtctctctgttttcctcctgtaacaaaacacttgaggtatagtcaggagtatttttggttagagttaataaaatatcccttggtcatggttgacccagcaatacacagaggcatgcataagattgtgcccaaccaactcttcatgttagagaagttttaactattagagcaatgcagagaatctactttcattctaaaagatttgattttaaaacccttcatccattgaaccagtgtacatgtcctaaaataaaatgtagagtaggattaatccaaactactatctaattgtattcttcaacctgatggcagaaggcagagagatgtagatggagatcctcaatgtctcagaatcgaggacatcactttgaatgtcccatgatctctaatttccttctatctatgctttgaattttatgatttgtgttttagcaatacactaaataaatatttgttggattgctgaagcaatccttttatggctcaccttactttcccgaaaaatacacctcaatctttgtcatttgactgcaatttcttcaaaatttttactcatgattcatgacacagagatagtacacaaagttccattctgtctgggatgtaagaccattaaggtattgtaaagcaccaagactgtgcttttgcaatttccctatttcagaatacatgttaagcaacagggttgctagtggtttaatcatggtcagtagtgaggtgtgctctgtactgactctctgcttcattcttgttctgtccatctgtgacttttgagcttgctgggtcactctgtgtcactcactaaatatctcggtgtcctccaaataccataaaatagtagataattgataaaaacatttgtaaccttgtcacttgatctttttggggatcaagaagtttaacatagttagataatgaatgggacctcaaatgtcacatctgtcttttaagccccagaaaacatttttcttgagtgaaagaaagattggaaaaatccttttccacccgtacttgaaggaaaatatttattttgtttacattttaaacatttcttgtaatgttaaagatggtgaagtgcctagagatccataaatggatatatattttttgtttgcttgagtataacgcttttaaaaactgcatctagtccagatatgggtctcataaatgtgactgttctctattctttagcactgtattatagaaacattggagaaatgtaacctatagcaagcaccacctcaaactgaaacttcatgcctttttagagttcacaaacattttttgacataaaacattactgaaatgatgaatcatctaataagtatgtcctttattggtatttcattttactatcaacaaaactctaccatgtactaagtgcaagcattatcattgccattttattactgattgaactccataattaaatttttattcatagatgaagaaaagagggtgtcgagggtgcaaatggttcacttaaaaacgtatttttatgactttcaatttcttaagagatgaagcaaaagatctgcctagccaactttcttaacccaagcccaaactgaaagtctaaaagatgtatttctggggaattaccccacctcaacattctcaggttttccagtgttctctgtctgtgtcagtattttgaaaacactaactcaataattctcaaaaatcaaagtctgcttttattatctggtaataaaataataggcatattaaccataatcatgaaaagtatattctttcaattctgttatagaacaaaaacaggttgtttttagctagtcaagaggtttgaaatattgtcaaattgcacataatagacaatcaatttaatatttattaaataaattagtgaaatttgaatctcatttgttaaatgaattagtaaaatttgggccttggggtggagcttagaagtgtgagggaagtttgagaaatagagtcagttgatttgtcacgtggaaaagctgctgattaagaatatggcactacacttttcaattcagaggatttataaacagaaatctaggtttattttcttaatctgggttgctcaaatggaaccagagtttcatatattttgcaaatctccctttggtaaatccccatttaacaataaagcttgaactttttgcttttacttctgggtattttgcttttttcattatcataaacatttttaaaccatggggaaactcttaataagtcatattagctctaccaggactattaaatagaggttctgggtgttttatttgaagaaaccgttgatccattggctcatcaccagggcagcaattatcagtatatggcatcgtttgtagcacaaagacatatggttaattgggggttctgtttaattgatctctttgttaaccagaactttacaacatcttaatacattagaaaagtaacatatgataaacatttacttttagtcatgttcccatttatatttagaatgggtctaatccatattttaaaatatatgcatacatgctttaagtaggattagtattgtttaagttctaacttattttatcttctaacattgtttatttattttatcttctaactgtgtttatttagaaatataccatgcctgtaatcctagcattttgggaggctgaggtgggcggatcacgagatcaggagatcgagaccatcttggctaacatggtgaaaccccatctctactaaaaatacaaaaaattagccaggcatggtggcacacacctgtaatttcagctacttgggaggctgaggcaggagagtcgcttgaacccgggaggtggaggttgcagtgagccgagatcatgccactgcactctagcctgggtgacagagtgagattccgtatcaaaaaaagaaaaaatatatacaaaattgactaccttgagtattcttttttttttttttaaataatagaaaaccaacatctcaagttttatttcagttattggctccgattttttcttttttctacccatggaatgcattgtaaatttttacttttatataaaccaagaaaatgagttttgttttgaaatccttatggctctcataactgcaggcatgtctaaatatgagatttggaacatacctcatagaaaatagcaagacaataaagagttaccaaagaattactgtaagaaaaaaaaattacccatgtaaatgttgaagtcatatcctgactgaaggaggaagtggcaggtccctgggctcaaccttatctgatgctgtgcattagacagcacactgctgactgttttcagttgtttctgtaacagcagaaagtgcactcactaggagtagtcagaattcaaaatgctcaagagaaagccatccaatgtttcagagaaggagaaacatcaaaaaccaaaggtaaggtgatttcatacatagttaaataaaatcaaactatttaatagaaaataaacacatatgtgtgtttgaacacatacaatgttctcatctgtcagtcataagtcaaacatagggtttaatgcctcatggcaaatacggaaaaattaaattgcaaagttagattttaaatcacacctagcaattattgtctctgtaattttgtcttatggtgcatattggaacatttacatctgtaagtgaagtttgagttcagttcaacttcaagaaaatcaatttagtggtctctgagtgtttgttattataaaatcttcttgcatgtttttaatgactatgagattgtcaacgtctattgaacagtctactgaatgaattttatctcttaagtaattagctcttcaaaatagagttataagaaggttgtaaaatggaaatgttatggttaaatataagacttttctcatttttgaatgttaaatcatgatagctcgttgtaaagatgtatatttgctattctctcgaactaatgttattactacacaaaaaatcgggctgtgttttgagaagcatcaaaacaccatatactggtagacttgacaaattggtaatatgtggaatgttactctgttctttgtcttggcaataagtgctacttttaaaaaaaaaaagtataacatgggataaagttcaaattctattgtagaactctagatttattaataacgtaaaacaactatttacaaagtaccaatgtcagaaaatttctccaatacttgtacatttcttttctcaggtaaatacaatttttagtctctttctgagataaacaatagctgagtccagattttttttaaggattgatttattgtctatcagtctttatatgttaggcacccattttcagagaaagagattggtttatttcatttgttatgaccttttgaattgatgagacattgaacaatggtcaatattttgaaactctttggaagttaccatccaagtttttctgaaggaaacaaaaataaatgatttcttatctttggaaactgagaataaatgattttgaatattaattctttctgacacatatgcataataatggatagacaagcatctttagtttaaaatgtagctagataacgtatcatgatttctttttccctaatataagaaaaactcaaagtaacattttccaaataatacagaaaagtttttaaaagcatggcttgtgcttccatttaagattaattttatatgatatttacttgattaagtacaacaaatagttaacaatagtaggtttagggaagatcataaaagttaatatggagaatgatatacctcaaagtatttaaaatctaaagagagagtatttaataaagcctgtattttatagtgagttagagtcatatttacaacattaaactattgtcaaaatgatactttactccatcatcatcatttggcttaagagcagtaactattataatacacttggaatattgttaatcttgacttccttattcataaaataaaaaaaattttgaaaaaatatacatctttgaacaaaacatatcacagaaaatggtcacattggaaatgctaagttttgttgtgaatgaattcttattttcattagacagatggtttcattctgcatgaatttaaagagatgtgaatatagaggcacaggcatgtttttcatacattcagttggattgtttccttttaacatggaagtgatatttttccatttgtaattatgtcttaaaataactcctttcctcataattcacatttattttggtgggtaattttctttgcatattatatgaataaagagcagtatctgtccaggtgcatgggctcacacctgtagttccagcactttgcagggccgaggtgcgtaaatcacttgagttcaggagttctagcccagtctgggcaatgtggcaaaaccccatctctacaaaaaattcaaaaattacctgggcatggtggcacgtgcatgtagtaccagctattcaggaggctgaggcaggaagattgcttgagaccaggagattgaaggctacagtgggccgtgttcgtgccactgcactccagcctgggcaacagagcaagaccctttctcaaaaagaaaaaaaattggcagaggtggatgctgtgataatccctacaaataaaaggctcatagaaaaaggagtgcaaatcctttcatttactgaagagaaattgtgtctagaaagggtctatgtttagaaacagaaccatcaagaaattggtctgaaatatagggaatcactgtcttcactgattaactacataccagatattagtttacaaaatttcctaaccaagaaacataaactcttcatactatactcttagaatttgtgaaaggaattttcttgtttttgtggtttttttttaaattgtaaatcctatagtagggtaaaaactgacaatataaaaaatgaagaaaatatttaatcatttagcttttgttaactgtcattggttctatttcaagtgacctattggacaattcaaatgcaatgcatattataactaatgttacctcaattaaaaatgatcaaactttccaattgaaagctaatggagaaagattttgttattagtattttcaaataggtcttacagttatgagaaggttcaaaacattcatttatataatatgtagcaatagattttcagtcctatatcaaaaataattcattattttcttatattcctaaaacttatcgataaacatgttcatgaatttaaaaagagtaagtccaaatacatgttaaaatacagttttaccatgtgtagtgttatcattagtgtaccctctttttcatcctttatttctctctttctctatttttagtataggttctctcctttgaatagctcaaaattaagagtagcattcaaatttattgtaagacacttacagtataggctgagaggcagagaccagagatattctataacagaaactggtaaattcttgcagaattattacaaaagaaacccattgcatgtactggaatgttaataacttctaagggctttaatgtgtgtctcagaactctctactgtatacagataaattccaaattagaaaagaaataggagaataatagttaagtattctgtacttaggttagttaaaaataggcttgcttaacatacatgcaaggtactgttatctttattcttgaattttgcctttaccttggaaacagagtcttgctctgtcacccaggctggagttgatgtggtgcaatcacataaccctaaccctaaccctaacctcctgggtggactcaagctacctcccatctcagcctcctgagtagctgggaccacaggcaccatgccaccagcccagctaatttttaattttttatagagatgaggtctccttatgttgctcaggctggtctcaaactcctatgttcaagtgatcttcccatctcaaaccacctcagccttccaaagtgctgggattacaggcatgagcaaccacaactggctgttttacctcttactactagtgtccattactgatagtgattttaaaaacttttaagcatatacaatattcagatttgatgagatgttattgcattacactctataaatgcttaaattatagaacataacaattttccttgtctgtttttccaactaaaatattttatttttctatatttatcattggtttattttcatgtcagttgctgtgcttacagctttttgtacactaatttatttaatatttgtaacaactgtgagagaatgactcttatttagcctcatatgtagagcctaaggcataaggaaggtcaattaccttgaagaagacacagagttagatgaaaaatgaaactgacatgaaatatgttaatttccaatacttctgttcttaatatactgcctttataagcaacaggactgtagatattatttctgtttccacctgaattgccagctaaagtttatggagatcagggaaaccatgtctgtaagagcgtctgtaagtttagaaatcgtcattcctgtctctgactatgcaggaagttcatcaaagaaatctctctaggcgtccacacacatgtcaacacctacaattgtaaaaaaactttctttcttttccgttcgttccttctttctccttccttccttccttttttttttttcagggtctcattctgttacccaggcttgagtgcaggcacaatcaccactcactgcagcgtcagcatgcctgagcttatgtgactctcctgcctcagcctcccgagtcgctggaatcacagtcctgcaccaccatgctcagctagtatttatatgttttgtagacatgggggttttgctagattgtccaggctaacaactttcttaatattcaaatattttaaaaaatgacctaatattgaagtaagcaccacatatcctccctctgcagctagcataatactttcaacgtagtagactctcaataaatatttgtaaagtgaatgaagtttcttcagtctactctaggggtgtctaatcttttggccttcctgggccacactggaagaagaagaattttcttggaccacatataaaatacattaacacgaagtataatttatgagctaaaaacaaacaaacaaacaaacaaaaaccacaaaaaatcacaaacaaatctcataatattttaagaaagtttatgaatttgtgtggggccacatgcaaagccgtcaaggccacattcaaagccatcatgggctacagggtaatacacccttggtctactacatacagcctggttcaagtatggatactcactcaagctatgtactttttttttttttttacaggattttgtttgttttatctgtctttgtttctttgtttatttttccattattatactttaagttctagggtacatgtgcaggtttgttacatatgtatacatgtgccatgttggtgagctgcaaccattaactcgtcatttacattaggtatttctcttaatgctatccctcccccctcccccaaccccacaacaggccctggtgtgtgatgttccctgccctgtgtccagatgttcccattgttcaattcccactgatgagtgagaacatgcggtgtttggttttccgtccttgcaatagtttgctcagaatgatggtttccagcttcatccatgtccctacaaaggacatgaactcatcattttttatggctgcatggtattccatggtgtatgtgccacattttcttaatccagtctatcattgatggacatttgggttggttccaagtctttgctattgtgaacagtgccacaataaacatacatgtgcatgtgtctttatagcagcatgatttataatcctttgggtatatacccagcaatgggatggctggctcaaatggaattactagttctagatccttgaggaatcgccacatagtcttccacaatggttgaactagtttacagtcccaccaacagtgtaaatgtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtcctttgttcactttttgatggggttgtttgtttttttcttgtatatttgttggagttcactgtagattctggatattagcgctttgtcagatgagtagattgcaaaaattttctcccattctgtaggttgcctgttcattctgatggtagtttcttttgctgtgcagaagctctttagttcaattagatcccatttgtcaattttggcttttgttgccattgcttttggtgttttagacatgaagtccttgcccatgcctatgtcctgaatggtaatgcctaggttttcttctaggatttttatggttttaggtctaacatgtaagtctttaatccatcttgaagtaatttttgtataaggtgtaaggaagggatccagtttcagctttctacatatggctaaccagttttcccagcaccatttattaaatagggaatcctttccccattgcttgttttctcaggtttgtcaaagatcagatagttgtagatatgtggcattatttctgagggctctgttctgttccattggtctatatctctgttttggtaccaataccatgctgttttgttactgtagtcttgtagtatagtttgaagtcaggtagcgtgatgcctccagctttgttcttctggcttaggattgacttggcgatgcgggctcttttttggttgcatatgaacttcaaagtagttttttccgattctgtggagtaagtcattggtagcttgatgggtatggcattgaatctataaattaccttgggcagtgtggccattttcacgatattgattcttcccacccatgagcatggaatgttcttccatttgtttgtatcttcttttatttcattgagcaatggtttgtagttctccttgaagaggtccttcacatcccttgtaagttggattcctatttattttattctctttgaagcaattgtgaatgggagttcaatcatgatttggctctctgtttgtctgttattggtgtgtaagaatgcttgtgattttcgcacactgattttgtatcctgagactttactgaagttgcctatcagcttaaggagattttgggctgagataatggggttttctagatatacaatcatgtcatctgcaaacagaggcaatttgacttcctcttttcttaattgaataccctttatttctttctcctgcctgattgcgctggccagaacttccaacactatgttgaataggagtggtgagagagggcatccctgtcttattgtttctttgtagcaagtctgttaatatgtgtgtaaaaatgtttgtgtatcagtacaactgtaactcattttaagctttatgttaagaactctaatatacccaatgttatgaaagaatcccattgttacctaaaggtagaacttggtccaggttaaagaatatggaagaaattttgaaaatagaaagacatggatcccacaaattaaagttagtgactgtaattagaacatcttggcctttacttgagagggattaatgatccgtgttaataaattttagcaggtttttctttgagtaaaggagattcaagtaccattgttatttttgagggaaacgttagaataatgacagttctggaaatagccttttttttaaccattctttttaatctaaagtgcatactaaatgagacaccattagtgtcacagatgctaattttcactagcaatgactgaagtggcattctttcccatttgcatttgatcctagcaatgatgagaggtgatgagttgattatgagctgttttcactgcactgcctgctgtgcaaatttatgctcctagacaaggatgacacatagttgtaccattaaagagctttcttcactgtttttttgtatcaagactgctaggatacatttttaactcttatctaaccaggtataagaaagagaataagtatttatatgcactggtgcttacttgaggccaggtacttgtccaaggtgctcatgtccattattatgtttaatcttctcaaaaccccaggaggtagacattatttttatctccaatttacaaagaagaaaaaagccctgtagatgcaaaaattttccacaagttaaaagatttgggatttatggcacagtttttctgcttctaagcctgtgtctctctcctcctactctctattacttcttcatctggggtacaatttttgttgaatgtttgccttttcaaacagagttttctggaataaaatacgtgatataaaatgtaggtaatatgttagatttactcttttcccctttaaaaaacggtggctataagtaaatatttattttaacttctagttattacctccgtccgctccaaaaacaaaacaaaacaaaaaaccagatatctcaaaaggttgtcttcatttttgtgtttatgtagcatttatagcattttaaaaagtatttttgataaactataatgcaaacataaaaccaaataagacaagtcaggagaaaatgaagtctagaacatgttaaaatgtatctcaaggttcatcaaggctgacttgaatctaagaacttgctactcactgtggtcctatagagcaacagcacgggcattccaggagcttgttagccatgtgcattttccagtctcccccaggcctacgaaatgaaaacatacattttaacaagatactcagcagttctgtgagcactttataatttggaaatgatgctctaggttgatggtttttggagcctaggccgaatatttgaatcactaaagagctttaaaaaaaaaactgatgattgggttccatccccaaatattcttatttacctaatataaaatgtgactggacatcaagaatttttaaagttttccaacctggcagcacttttttctacttttcaaaagacttaaaagttaattcactaatccatgcattcgttcattcatttatccttcaacgcaacaaatgtctattaaatgcttattatggacaatacactggcgataccaaggtgaacaaaagataccatatttgctggagatgacagacaataaataggataaataagtaatatatacagtatgctagataatgataggtgccaagaagaaaaaaaaattaacagaaaagaaggatttgaaatatgaagaactagagaagccttggtgagaatgggacattggaaaaaggactggaagaaagtgaaggagctggtcttgggattggtgaaggaaactgtactctgggcagagggaagagcaagtgcaaaggccttgaaatgggactgtctctggtgtgtttgagaagcagtggggcagagtgcatagcgggaagagccgccgcaaagagctggatcactgaaggcgttctaggccattaaaataattttagctagtgttgaaagatgtttgagaagtgacagaatctggcctacagtttagtgggtttattttggcttttgtgtttcaaatatactgaagggagtgagaccagttaacagactattgcagaaaccaggcaagggataactgtggttcagacaaaggaacggcccagttgacttgggtgttgagaagactctaaatttgggatatatttgtacttactttatccatttggatgtttataggtaacttactacatgctgtctaaagatggcagacagaaagtttccactgtccggtcccattcttgcttccagttggtgcttgcatgccaaggagaaatggcctcattccattgtttacagtcaccagaaattcacccctaaattgatgtctcactttccaaaggcttcttcttcttctttcttaaacatataattttccattggattttattttaattcgtagtgcaccttttaaataatttttagccttgaccacttctctccaaacaaagcactaatacattttagcttttccgttttacagaatatgaatctgtaatcaagttttatcccaagcaggtagcaaaatgtttggggccaaatgtattagctatacttgaaaagtgttcagataatattcagaaagatcagatgaatagctagagaaatgacagaagtgtagcctcccctttgtttggaaatttggatattgtattttataggaagctttataaggtcactaccttgactaccaagatgctggatttgttaaaaatcaatttagtcacacacttatctctttagtctttctttgccttgctttggagataaatagtttcaaaatccctgaaaactgtgtttttttttgtttgtttgtttttacaataatggaatcaagtccatgctttacatatccgtttccaaatttatcattaccaaactgatccatttctcctcctttctagtgttaaagatttcgatgaactttcagaaacaagacattcatattagcttcttagtagaaaacaaaaatgtcctccattaagaattgattactaatagcagaagattttaaactatctctgttggtagatgaagtgattcttgcatagatagagagagccatttgtcaccacagctggctaagtccccctccttccttcacttagtctgtattagtttgctagagctgccataacaaaatatcagagtctgagtagctttaacaacaggaatccactttctcacacttctggaggttggaaacccaagatcaaggtgctggcagggtgggtttcacagagagctttcaaggaaggatctgttctgggcctttctttttgacatgtagatggctgcccttttattgcctcttcatctgtgtctgtgtgctcctgatgtctctctctgtgtgtccaaacatcatcttataaggacaccagtaggaacggattaggtcctaccctaatggtcacattttttacttgattttctctttaaaggctttatatccaaatacagtcatggtctgaggtacaaggtgttagggcttcaaacatacgaatttgtgggagtcaattcagctcataacatagtccatgagcttgtactaattggaagtgaggattaggtttttagttgtttccttccttccaattactctagatctttctccacttccagttgaccaatcccttcatgctgccagccccacatttgacttgactgcctttacctacactctccagtctttgttattctttccttcctcacatccaaatgtaactctgccacaacccactagacctctattaggaatcatttgaaaactaaaaagtaaaacatctatttgacccccttgacccatgctttctggctgcatattaaaaataatagcaaaaatcatgattacttttgcaccaacctaatattgaaatcatctggggtgttttataaaaatacctatgtctgggccctaataccagatcttctggtttggttggtggagtgaggcccgtgttcctgatgatctgaccactctcatacatttctgtctgtgcttctcttagcctaaaatgctctgtgctttttttccaactcatgaattcttatctattcgaatttataggtggactgtcacttcctcaagaaagcctccatcagttaccccagggtagtgtattagggtcagtctagcagagcagtaggtaacgtgaactaaaggcatagagacctgagtgtgaatgtcttactttgatctttcttaaccaggggactttgaacattttcttaagcctgttgagcctcattgtggtaatcatgaaaagggaaagtcttaaagcatgtcacatagggttgatgtgagaattaagaaaattaccatatgtatgcttcctagctggtagtacatgtccatttaataatctctccttctggtggcgggcacctgtaatcccagctacttgggaggctgaggcaggagaatggcgtgaacccgggaggcggagcttgcagtgagccgagacagcgccactgcactccagcctgggcgacagcgagactccgtctcaaaaaaaaaaagaaaaaaagtctctccctcctttctattttcgttgtgcttgttccacatttctctgtttgttgttgttgttgttgttgtttaaactcacagtttttcagtatgtgctcccaactagattcaccatcaagaacagaggatcaggggatgtagctgactcatatttgcatccctgggatttttgttgaggattcaagagggattgaactcggtctacctgactttcagattccgtgtgctttttataacactttggccaccactgaaaacattgatagtatagaacatagtagtgatttctcaatatatgtataatgagtgtgaaatgactaatggataatattagtcatctgcagaagtagtctactccagaagatagtttgtaaatgcgtcactgataaagatctgggtaacacccacaacaaaacaaagtaaccattcctagaatcaaaataatcacacattgtaatgtaatctgccttaaagacaaaaagtattagcaaaagggtgttgctttgcagacagcctagaaataggtgggagagtagaaatttgccactgtgtctgcaaatcatgcaaaacagctgaagcaaaaatcccttttggctggacagacttctcttaggtgagatgtgtacctaaggctaggagaagaacttcatgtctctagtcttaataccacttaattgactttactttgaccaccacatgaatcaagcaaacttccagcaatgatctggtgtcctgtgtagggtttctttcaggggaaacaattttttgatcagtcaacatgaatatgcatttttcttggcagatgaatttcccacagcaaatcaatgctcgcttggttagtattgccatttttgatatcttatcagtttggtttatgaattagtcaccttgaagttgtatatttctgcaagcttaaaaataaagttcccatacttgttgaggtgagggcgtgaccctggacatagagacgtgatacttgaccaatgtattgtcttcctaaaaggattgagctaagttgctaactggcttcacttccaggtacattttctctacaaaaggaaaatgaatacaattaaataactaagtttctttattatattttttatagttttaacagcttaaactcctggagtaagagtcaagtcaaatttaccttgtatcaaaatctacatagtgatatggcattcgtctcagtatttggttaaaaagagcaaattggaattttctggggttttttttcccctgaatactttacgtggttacagttatgctactgctatttttaattaaataagagtggctgggcatggtggctcacacctgtaatcccaatgctttgggaggctgaagtgggaggattgcttgacaggagttcaagaccagcctgggcaacatagtgagactttgtctctacaaaaaataaaaaaaataaaagttagctgagcatggtggtgcacatgtgtagtcccagctactcaagaagctgaagcaggagattgctggagcctaggagttcaaggttacagtgagctatgatcacatcaccgcactccagtcttggcaaccctggagcaagagaccctgtctcaataaataaataaataaataaataataaaagtaataaaatattaaatatgtacattttgtaatacttatgattatagtttctttatattgtaagttattacatagcaatcatcttttatcttttgtttgatttgtatgttaggacatctaaaaatttcaaattactttaagattatgactatctcactgtatttaattatcaattatgaaaaagtcattaccaataaaacaaatgtttataactttaaaaatacagttccttcaaagataaatgttctacaattattgaacattacattataggtcaaggagtgattataaactgagtttctttttaccactactcttatatttcaactctgctattaaccccctcaggagattgaagtattcatctaaccaaatcccagttttctaaaaggtaaataaatgtaattgacaataaaaatagttataggacactaacatctcttccaaacttcctaacatgaacttactgttttattttcccacccattcttcctctatttgggatgacataccatatatttgcccccacataaacatgtctgttcttactaagaaaaaaagtgtttaaattcctaagaccagcagcagtgggtgcttcctgggatgggaatgtttataagctttatgatattaactgcagcactcaacctcaggtggcataaagcatgcaaaaaagaactttctgtcagttttattatttctaaaaaggttccccttgaaacagaagagtgaccttgctctgctgagctgacatatgccactggattaatggtcgagctctgctggagggaagctcacggaaacattacaactccagaagctgggctggcggtgaccattaatcagggggcccaaaatcatgcatcagacacactcatttaaaagtagtaaaaatgactcaaaaaaaaactttttgagaattagcttattgtttgtcattacttgtgttcaaggagatcacagaatgactaaaatatcccttgggcagacctttagaaaggttactgtgtacccagaggccaagtgaatgcagaggacttttaagactaatggaagtaaaagggagtttttgttccagataatttgataggaaatttggttaaaaggattttgttttcccaacttaatttttacatctttatttaaccataatttcaaagtaatgagtactataaatgtttgcctcttggtgataattttattttattttaaaatctggagtgactggaatttactagtgtaaagatgagatgggtaaactgttaggaaatatttcaggaaactaaagttttgttagcatactcaattatcacgtatgtttaaaagttttggggcttaaaagtactgcacattcttccatcatgttagataataaaaaatttttgagatttcctctctctgattattgaaaagaaaaaaaaaagcttacatctaagatcctgaaagaaattgctcaatttaacttagctaataatgttactcttgggttttcttttttaactcctttgatgataaaattgaatagacataatttctcttttatacttttaatagtttgtcttttagattaatgacactatacaaaatacatatgataaatcttattaacagtacaacaaatagaaaaatcagtcacttattacaaaaaccagaataaatttggtatttaagtttatggttaatgtagtaaggtctattgagatcaatattcgaagttattcttctcttaactaatagttgcttttttaaaccatcatcttcaatattaccttttgtctatttgccatatcctatacagcagtattatttaggcagaattatttatttgtagaattatttgtttttgtttagttatagaattaaaatagttgaaaatgatgtgactagttaaaatattatttaatattctataataaatagaaaaataaaatatgcatagaaaagacagttaatttccaaacttatggaagaataatgtatattttttgtaaattgaaaatttcagtcatccatcttttgaattgccctccctgtatcaaggtacctagataacaaaattagtaatgcaaaatttgctcagggaaataatttgagtagaggtggcaaatgcagttcctctcttcttcccctaaacacccactatcttctgtaaccactgtggacacagttaatcatgactttttaactctgaaaatggctttagaacgcttctcaacacagctcttcatgaaacatcgaccaactatccatgctggtgcatgagttgaaaactttttgtcagttttagtttcaagagatagttcatccagacaatgaaaaatcccagtgaaatatccctataacaaataaaaaatatttttatagtgacctaaatgattatgtttactagagacagtatttatttctctcctatgaaagtttgggagagaattatattagatactagacacattttttatcatccagtgatccatcttatacatagcatatgttccactacctttcttacttatcataactttagcaatcacaatcttcggatttggtgattatttctttcttttttttttttttttttttgagacggagtctcgctctgttgcccaggctggagcgcagtggctcaatctcggctcactgcaagctccgcctcccaggttcacgccattctcctgcctcagcctcccaagtagctgggactacaggcacccgccaccacgcctggctaatttttttgtatttttagtagggatggggtttcaccgtattagccagggtggtctggatctcctgacctcgtgatccgcctgccttggcctcccaaagtgctgggattgcaggcgtgagccactgcgcccggccagatttggtgattatttctaaagagcctcttgtttaacaattatacaaatctactaatttttgaaaatggttaagtgaattcaaattatattgattccagctaattttactcccaaaatctgtgattattttagtgtatcattctgtagacaaactataaattaagtaggtataggcatagacacataaaatgcctttcaggtactaagtagtcaatacaaatgagtatttgtaaatgaatgaatgcagatttccaagttgacatctactatacattttaacttcttttattttgtatatgaatataacctgcttataggaattgattctatatttgtgtatctttcatttgaacaggattctatttagctcttatggtttggaatgatttggtccatggtactaatatagtatacatttctctcacggttgattcttatttattcataccgacagcccttactctgagtactaagttgagccatagaagccacttagtgtatttatgttaaattacatgatgcaaacccttatggtctttaaacatcaacaaattattgtcattagttgcaacatgattaagttctaatttatttttgtgtaactgtgagatgtaagatttttgacatttaacttgaagagtaatgtgggatctgtcatttgccatggttttgcccaagtctcacgactgtaggatttttatccattggagatacagcatgtaataacagcaatcaatatgcactaaaacgttcactaaatggcatcggaaaagggtttcctaagggaggtgagacttaatcctgccctcgaagaatgggctgggtttgagtaggtggaataaaagaagaccaatattccttgaataaaaaacagtaggagcaaaagcttagagatataaatgagttcgtccacagtggccagcaagaagtgttagaaattctgctaaatcagattgactagcattacccattaccatacagaatcacacatgcactgaatgctgagtatgagctttattttgttgactgaggaaaaactatttaaacactctgagcctcagttctcatcatctgtgaattggagaagttaatgcctaactcagagggggattgtgtttatctaatgaaataattacggataaatagcatggcatggagtttggcagatggaaagctctcggtaacggtcatggcaatgtggagcaagctttacattttggaaagaagaatgagatgatgagacatggtactttagatgattagaggggcaagaatttggggacaaataatctgaaagttgttgcattggttcaggaattagcacacacttgagtaaaagtaatgaaaaaaataccttcaataaagtttggagaaataattggacatatgtacaggctgggagaatgtgcatttgtggtgtgttacattttacattaagtgtccaaactctccaaagacagcaatgagcaaataccattttccaatggggctggtaaagtttcagaggttgggccaaaacagatcctcaggggagcaggacataagcacagagcctttttttagtacatctgccttgcagcccagaggcaggcagagggtgccttatgggctggggcaggcataaaactgggttccctggggaaattcttgagaattttaaggaagtgttggcataatgaaagaattccaggaggaccaagaagtaccatttatttattttagtatttattttagtggtacttatttatgggcttattagttagagaagaagagaaagaaggaatagaaagtgcacaataacataattttataggagtgagtaggccaagcagaagtttcacaatagggaaaacaaattgagcagttcacgatagtgtcatcatgggcacattttctaaagcttttcatttcctttttaatagttttttaaagaattgattataccaattcttcggccatcttatgctttctacctgaaaaagcaatatttaaaacatgtaacagtattatttaattttaatatttaaaacatatcaaaatattatttaagaactcctttcaagtaaaatagaatatcataatttctattcatttcccagaagtgtagcatgacttacagtctatggatacaatgtaaataataagaatgagatattgttgtacatttgggtcttttttactcatcagacttgttgcataaaataagctggtatgaataaccacttttagaggttatggatcattctgcatttttttttttttttttttttttagttctagtttctttccttcaggtaatcttggagatggtttcaatttgcagaaagcatttctagtgtcacagcaacttctgaaagcaaatctttagcatggaaattttgacaaaacattgtaaaaccgtggtggaatcagaatctgcacttcttgaagctattttgcagttgatagaaaagttactgaaccagagagatagaatagaccagcttttgttcttagagtccagatgtacgttgaaaatatttaaagcattggtatatgtttgagctttgggttgcctttatccctggataaaacgtgagtgtcgaagacgaggctttacagctctagttgtcttttagccgtcagtttcctgataccccacagaagtgtattccactggtaccacgtgacactgaggcaattctaactgattattttaagagagttaaatttgtttcacctcttcaaaagatctgagtacccgagttagttagaacaattaaatcctcgagtgtctttggataaaggctgacaagcttattgagattcagcttttattatagtagaatattcatataaggatgtgctgaaacagaattctgatctttgagtacattactaaccaacgttctttgtgcaatatttaaaagagctgagaacttgttgggagagtgtgtgtaatttttaatttgccagtgtatttcaaagtactgcagatgtgtgcctcacatatgcaaatcttttctttgaaatagactgtgaaacttttccaccagcaccttacccaaatattaagtcatgctggagatgagatttcatttgaagactcccaaagttagtggctggctaagaaagaaaatgagggtcaagttcttctggttttgatcacaagtttgattcagatttctacatagagaccctctaattttcattcatgttcataaatgcaggctggtcagtattctaggaaaccgagttagtttcattctttctatcaaactaactttgccgtaatttttattctgctcagaaagcaagcctcttgggaagaagacaggatctagattctgtaatggaatggcataggggagagtatatcagagtggagaattttttaaaaagaaattttttgcaagttctggtttcaacagtttccttattgagaagagctagacgataactaagaacactgccagctttatatcatgaaacagtattctgtaataattaggattgttttgcaaaactggagaggtactaataaaaaaagaatctccttaagttcttttatattactcattagattgcatagaaacacacatacacaaatgtgttcaaacaccccagctgaccctggttctgtactatttttgggtaagccaagtggactgtgtggaagaaggttaactgcaccatgtgattgcagatagtcttgaaaacagcaatccaagggcacatatttatatcagaaaagttagttgtattaaaatgaatttaggaaacgcaagtttattttgttccctttctgtacttccaaacaaccatgacctaaaccatattatgattgtttttaaacaaattgattccttattaaagttatgaaactggctgggcatggcagctcacacctgtaatcccagcactttgggaggccaaggcgggcgaattgcctgaggtcaggagttcaacatcagcctggctaacacggtcaaaccctgtctctactaaaaatacaaaaaaattagctgggcgtgggggtgcaagcctgtaatcccagctactcgggggggctgaggcaggagaatcgcttcaatccaggaggtgaagtttgcagtgagccgagatggagccactgcactccagcctgcataacagagggagactcggtctcaaaataagtaaataaataaataaagttatgagaccactaacttttataaataattttagctattatatagaaatatttcttttgataactcaacaatttattatggaacattttaaatatatgtaaaattagagagtagtaaaatctacccccatatagccaccatccagctaatgattcaagaatggccaattgtgtttcttcctcatagccgcacatttgctgctcctcgctagattatttcaaattgtatataagagagtaacattacttccttaacatcaaatagctagtcatttaaaaaatttacccagttgtcttttgatgtttttggtatagtggtttatttgatctatatttaaacaagattcatggattatacttggataatatgtttctgaagtctctcagtttatactttaactctttcttaaaatttttttatattgatttgctgaagaagctgggttgttttgctctgtattttcttgtctgtattttttccgactgactgtatcttcttggtaacatttaacatgctcttctgtctctttttttccttaaatgtggtagctagatacagagcttggtgtgattgctttcttgcttcctttctttcttataaacaatatctcattagttgtatttaatgcttccatcacaaagcacatattctggttatctccttttgtgtgattttagtggccattgatgatcattgcctggatccaacattgcattaggggtttgcaaaatggtaatcttattatttcatcatttttaattgattagctgaagtatgaacatatacagaacaatttcccctcatcaactatttagttgatgaactatttagttgatgaaataggtttcatacaggaaaggcagattaaatgtctaagttgtccctttatttgttagttttcagaatataattataacatttcccaatgtaactgatgcatttttctttttagtatccttatgaactcatgaattttgacattagatgtatttcaatatattgcacttttctccattttactttttctccttacactgtatgctagaggttattctgttgcatataaaaagatgtatttaattttttacagcttcatacatttgcattgtgtggatgtaccatatattattcaatcagtatcctcttgatgaacattaggctttacagctttttgataatataaaagtgctacagtgaatatggaaatgtaaacaattcatatacaaatgtattgctgataaagacatctagaaatggaattcttgggacaaagggcaaatgtatatgtaattttgctagatattgccaaatttccctttataggtattgtgccattttacaaatgcatttctaattgcataaggaaagactggaaacattcgtgtagagtataaagactaaatatgatctaaagtcaacagacacaaagaattatctaaaatatatatagcatttttatttaagctcatcttctttttgacactgcttatttatataataactctgtcttgataagaacttctgtcataagataatatttactaagtctaatacattacaattatataaacaacattatcaatattcaaacacattctcatttattaagtactattatttaggaagcaagctttgtttccatataattcaccttgttatcataaaactttacaagaacagaagtcataaatgtgttcattgtccagacctcatagtagacattagtccttttttgtcataagccataatctatacatcataaaaccatctgagaaagttagttactaacttttaaactagagaataatgaacaaatataaatgttcttttaaatatttagattttcttcttaagggtgtcttaacatggattgatatactcctatggcataaagctattgagtaattagtgatgagatgactgacaaaacccaaagtaatagtccagtgtccttcttaaaccacgactcctaaatctgcttttctttattgatataatgaggggagaattaattttaaaaggtggtggctattgattacttaatggaagaagatagtgtagcaaaatgctgaaacgagtctattctgtgccctcctgtgcaacaggacccattatcccattgtggaaatcgcacccttactctcattaatatttaacaggctatatataggctacaaaattgccttgggcatgggctccaatcagccatagaatggtttcaagtatataaaagagtaatagatttctgtgtgttcagattgtttataagcaggacaacaatacgctcaattcccttctgtgattgctgagcaatgacagccagatggaaacacctcctaggcaagttggagtgattcatattctgggaagccactgtaggctagtaagtactacataagaagagtttgtattttccagtgtggttctcattttcagctttcgtttctgctcctctcaccacaggctgaagggctcgtccagccggggtggcaaatcagcaaaaggcgttaattgtgtctaacacagctatcatccttggggcaatattctgtatcacactgtctatcaagctaaccccttgccagaggtcaggatctttttatttcagttcttttaaaagggaaacaaaaatctttaaagatagctggtagggagacataagagcttctagggactaggagcccttgaagttgccttgtactaaaatgggctgtgatttctgaaaggacaatatagcaggtcctccaaaaacagttttctccaacatcattttgttataataatattgatggagaaaaaaaaatcagttcctgaccagggtcactgtctgtgcagggtttgcacaatcttctcatttatgtgtgggtttccccccacatcccaaagaagtgcattccaggtcaattggcattggcgtgtccaaattgttccacaatgaggagtgtggatgtgtgcttcagtgtgccctgcgttggagcagcaccctgtccagggctggttcctgccttgtgccctgagttgtggggataggctctggccactcacagcaaccctgagctggaataactgggaaaataattatgttaattttttaaattaatttttcttaaatatatgtatggatcgcatttgtttcagtgtttaccattagaagtgtttgggtctttatttagaaatttgatgatgtttttgtgatgaaaagtagatcacaggaacttgttatttgaacttgtgatttcaagtagcctatggtaaagtggattttgttacacctggttttgcttaaggtagcaatttccgagatcccattgagagcattaagggaggccttgttgtacaaagttttatagattactgactcccattattaattttctaaattaccagattatatgtcagtaccaccagtttgtttttaaaatatgataaacttgaaataagataaagtcctttagaaagaaaatagtctcgggatttatgagtacacaaagaacccaacatcagatatccaccatcccaaacaatgcataaaattagatagtgaggaaatatcaattttttgactcaatgactcaaaagaattttaaaatatgtttaagggattcatttattttgttgcatatcagaaattatttataattgcctgcctacattgagttgcataataaaaatgtagctttgtaagcaaaaggtattcaagacaacatcttctattaacatactgagctttttctcaaaaccagtgaatgaaactgacccagagatctcattgtaattctatgttaaatgtggaaaaattccattttactcccaaccttggactgtgcatacctaaatgctgctttcaatttattagtaagtctgtgtgtgtgccttctttttctgatacccagcagagaacttcaaatgatcaagagttggtaatagaaaatgcacttatgttctttttttttttttaaacaaacttggtcttttattttcatttttattttaattttcggggtacatgtacaggatgtacaggtttgttacataagtaaacatgtgccatggtgttttgctgcacctgtcaacccatcacctaggtattaagcccatcatgcattagctatttttcctgatgctctccgtctccctgccctccaccccacaggccccagcgtgtgaacaaacttgatctttgtgaggcgtaatggtggatctactcagatgcttgctttttgtttgtgttttgttgttgttatttgtttgttggttggttggttagtactacatgctgttaagtttgtggttagctcatttcaagaagctttagtttggaattcaaggattcttcagctgccacttcaaagagcaaaattaaaataaaaaatttaaaataatttaaccaagattttctccaaggtgcttacttaacgctatgacaaaaagcgtagaaagacatttgatcaactgtaaatataaaaatgttaataggtataccttcacagcctttggatattccagagagaagagctttttaaagcctgtatttgcaagagacggtgcttattaaactataatctaatatacttatcagtttggacagtgaaaataaattctaagtttcctttgctttttcttttctattttatagcgaagcagcagttttgggaatttcgatcgttttcggaataattctttatcaaaaccagatgattcaactgaggttcgtagtttattccatttttatgaatgttatgcaaacacattatgaaatattatgaagacaatgtcacttttgcaaagtaaaataagaaaaatgaatacattttaaaattatagccttgcatatgtttttgtgataaatgaacaaaccattatttagtactgttgtggaaagcaatgggttcttgtcacacgaccaggaaaatttaggcacacagacacattgtagggtgagtagggcagggtatatcgggtgaaaaggaaaaaaaaaaagaggaactctcagcaaagcaagagtcctgctagcaggctcctaccttacagattgaatcccaggctaccacataacaacaaaagaggccaggctcctccctgcagcaaaccacacgaccttcccatagctccgtccccttcccccagtgcacaggtgggcattattaagagagaatcagttgggaaagggtgggcttcatccaggatcatcagtctggtttttcagccttcaagctgttttaggctcgaaggggaggtttcgcaagggaccgttggctgtttcctgtctctatcagtacccagtaccgtgcagggcattaaaagtaaaatcttattttaagaagcctaacagatgtttgggaaagcaaaacatgaacccgaaaagatagaattcaaactgacactgacaattccaaatttcctgagtatttctactataaaacaatgtgagtatacatatatgtacacatacacatacattgtatttatacacattatttgatagatatatataaaatgttatgtaagttgtaattgctttaaattagaacaagattaagtggcccaactgtaaatttgttaaggagagcatacagctgctcaattggactctcacacttcaatgtacactgaaacatcccattggtgagtgctacatacacatttgtacactatgaacattttaaccgtagcttaagaaaagcttcccataaaataaagtttacgtaataatttcaataatatgttcatttagttgagcactcacgatgaaataagcacaatgctaactttatctatctataacaatttacctatttataacataggaactattagtatatctattttgccattgcagaaatatgcttgcttcatcaaataaaattacttctaaattacagagtgagtaaatgacaaaggcagaaatcaaccttttctctgactccaaagtttgccatattatctcataaagtaggggccacatatgctaagtggttaatgacaggtacaacaacaactaataaaatagtacagagaaggggtgtctactaagaaaactgaaaatactgtttaccattgaacctgattcagcaaccttacaggtaatatattctttttagatcaataggtttttagatcaataggtttttagatcctatgcttattttcaaatataactatctgtaatattttaaaataatttaatttcagtaatgatcccttttattaatttattatgtatatattcacatttatgagtaaacttgtacataattgtatagtcaatcaacatttacataattgtaagtaataaatgtaatatatacatataaatctccccctggccacatatatgtgtttgtgtgtgtgtgtgtatatatatggagagagagagaaactgtatataattttattttcagttggcattttgtataaatttttaattctccacaatcatacatatattctactgctatttagtttataattctggaattaacctgtacaagatagctcatgttcattcaggttcattggttaataatggtggcctagtaatttgtaaaagaatttagcaaacctaataaaatagtgtgcatatttttcaacaatccagcactcattcaaaaaataactactctatgacaggttttcccttagacactcaggaagtactgttgcaacaacacatgaaaatccttacttcatgcctggagtctataggggaagacaaatcttaaaaagacaagaacaaaaccataagtaatatttaaatagaaatttaattcaggctatggagaaaggcatagaaaaatgttaacactcaaaagacataaacataatttctttgtagcttctgtaaataacgctagaaaaacctgaaaaatatgtgtggtacatttttctgaagcttagaaatggtagagtaacacaagtaataattaacatttcttatttatgttagcaaagtaattttataatgaagacagagaaagtttaagtagagagaagaaaaaggctaactctaaaattttaaagtgcttccgaattaaattttattcaggacttttgaattaagcaaagaatctttgccttgatttcaaccttgaatgtagaaattaataaagtgcaatgagggtttaaattggctgtccattcatatttatcataggcaatttggggtaagatatgaagcaaaatataatattgattaataatgatgttaactatgtggttaaacttttatattaaaatattcaagttcactaaagagaagtttcccatcattttttatattcagtgaatgactacctgtccacctaccagtaatggtgggcagtgttaaactagatgtccttcaagtttcctttcttgcaaatataaggtattttaggacgtgtaacccaaacatgtcctccaagaaaaaaaaatctgcaacgttctacatgagaagtttcatttattcaaataatatcaagtgccagctctgtgcttggaagtactctagacactcaaagaaaacagacaaagtctcaagtctcatggagcatgcatcatagtgggagacgcagacaataatcaaatgaacaaacatattatcgggtaatgttaactgcttagaggaataattaatcagggccaataaacaggatgtatggaagtgtggagggtgatcaatcagaaaattactctcctattatatgacatgtgaatagaaacctggacgactgaaggaagaaattcttggatatctggcggaagccaatggcaaaagcaaatacaaacttggtgagaacctgatagagaaactgcaagggggctagcatggcaatactttattacagttgttttcaaactttagcgagtatcagaatcacttgaagagcttgctaaagcacaaactgctcccaagtgatgttaatgccgctggtccagggatcatattttgagaaccactgatctagtgagcgagggagacttgagaagtagcgaggggcaaggtgggtagtgaggatattttatttcatatagattctatataatgtaatatatatcacataatatattaattatattgacagaacattattttatgttatgacatatagagtcttgtggctgtgaacagagtgttttattctgagtcattggtttaacaaaattcctaagcacagactgaagcagtccaaataagatgtttgattaatatagcatgtgaattacatgaagatttctgtactaatggctggaactagttcatatttactattgcttgcgaatatgggaaatgtgcacactaagatgaaaaaaaatctaacatttctcagtggatttaattaacacaaaaacttctttaaaataaccacaatcatctcaatttctatgagaagcaagaggatattttaaggcctattcaacacagatagatgctacagcctatctaaagcttccaataaaatatttctcatctatgtagacataagaactccttatacctggtgtttaatattatttgttcatctcaagaagagggaataaaatgattcttcaatacagctatttaaaaaatagtcaaaattctctaaaagagttgcagatgtgaggctcaagtcctttaacatcacgaattttactttctgagttcgtaacacaagcaaccagggctggacaactttaaaaatatgtgttatgtccggattgttagaaattttggaggctgctgcacagaatgcatgcaaaatccacaaactcagaatgttctctgtaacagtgatttcagatcaatgttttttattgctttattattttgtcttttgtaaacaattctaaactaggcacatgaaggagatcccacaaatggaagtggagaacaaagtaaaacttcaaataatggaggcggtttgggtaaaaaaatgagagctatttcatggacaatgaagaaaaaagtgggtaaaaagtacatcaaagccctttctgaggaaaaggtaaatattctctgataatcatttgtatttttctactaaaactttcttaaactattcagctagactatagaagtgcttggtactttatgaagtacttaagcatttgttttcttcctcagtcattatgcccagaacttgggtggaaggaagtattactttcattttaacagaagaaactgacactcagaaagatcatgcatctgctgggtgcagtggctcacacctgtaatccgagcactttggaggccgtggcgggaagatcacctgaagtcaggagttcaagaccagcctggccaacatggtgaaaccccgtctctactaaaaatacaaaaattagctgagcatggtggtgcacgcctgtagtcctagctactcaggaggctgaggaaggagaatcgcttgaacccgggaggcgggggttccagtgagccctgattgcaccactgaacttcagcctggcaacagagcaagatggcgtctcaaaaaacaaaacaaaaaaaaagatcatgcatctagaatgtgatgcgaagaacaatgtgaagaacaacatgtcattaatttagtagcaagtatcagtacttcattcctttttattgccaaataatatttctccttttatagatggatcacatttactttatccatttatcacttagtgattacttgggttgctttcactttttggctattatgaataatgctgctacagatacttctgttcaatttttgtgtggaaatattttttcatttctcttggatatatagtaactccatgtctaatagagaaactggcaaattgtttttttaagcaggtgtgtcatttgacattcccatcaacaatgtatgagggttccaatttctctgcatcattgccaacacttgttattgtctgtctttttaatactagccatcctagtggatgtgaggtggaatctcattgtgattttgatttacatttggttgtactttacgtttccctgatgactaataatgtcaagaatcttttcatgtgctttttagccatttatctatctttgtggagaagtgtttttcaaatccattgttcgtttttaattgggttatttatcttcttattgttgagttttaaatgttttttatatattctggatgcaagttttttatcagatatatgacatgcaatataatatattttctccaattctgtggattgtatttttattttcttgatggtgttgtttgtagcacaaatgttcctaattttattgtagtccaattatctttttttggtcacttgtgcttttggtaacatatttaacaaaccattgtctaatctaatgtaatgaagatttattcccatgttttcttctaagaggccaatagtctcttaaattttggtgtatcatttatttcaagataattttactgtacagtatataggaagagtccaccttcattcttttgcatgtagatatatagttgtccttacactatttgttgaaaagactattcttttcctatttgattgtctcggtactcttgttaaaaatcaattgaccataaatatattgtcataaatatatggatcataaataagtgagtttacttatggactcccaattctactttattgatttttatgtcttatgtccattctctttttcaatccacttcaacagggctctgtctccagtactccattaaaatagctgtcgccgtcagtagtgacctctgtgttgccaggtccaatggtcacttttctttctccttactacttttcaactgtatttgacccaagtgctgatttccttacatataaaacatccacttttcttgtttttttttgactaggcatgcttctggcatttcttcttcctcatagcttcctttcttggctctgctttctttctcatcccttgaaacatcttcctgaggcttgttcctggatgctccattgaatctacattctccccttaagtcagctcatctactctcatgattttgtttttcacaactatatctctagctatgacctcttcacttatctgctatattaatacaatcaattgcttatttgatatcttcatttagatgtccagtagacatccaaaacctaatatatccaaagctaatatatttattctctacacttttacaaaaaaaatggttttctcatccagtattcccagtggcagcagacaacactgatccccaaaataaataaaaacaaaaatataaaaaataggaagaaaagaaaatctaagaatcaccctaaattccttctttttctcacttttcacactaattcatcagtaaattctctgaattgtattaccacgtatatataaactccctaatttctccatgtaaactattcctgctttagactaaataaccaacctttctttcctggattactatcataatcccctaattgctttccattctttttattctttcccccataaaatttattctccatatgaaagccagaaatatctctgacaagtggaaatcaggtcatggttaaaatttcagtgtcttcatagtgaacctctttacttggtgtgttcattctagatcccaagaaaaagagtagaaacaccacagatttatgacaggaaatgctaggaaggctaaagagaaagcctttagactgcaacgtaaatctgacatctgtaaaaggatgaggaaaaggaagaagaatcaggtagagagagtctcatacttcagcagaatactgagaaagctttggtcagattgatggaggattcttatactaaagttttccattacaggaaccctacattccactagaatgggctcaaacaatacccctattttttcagttactgaaagggagcatggctttagtgcaaatggagtgatggatacagaggggcagtcctgggactgtcagtaaagaagggtcccgcagcaagagatctaagtggcacatttccatggccaccacacatggtctataaagcttttcttgatgtggctccagtctacttccctgaactcacacactaatattctcctttctcacactacattagccttgctgttttccctgcacaacccaagataattctgagttcaattattttgctgttgctattccttttgcttggaaaactgtctccaaagcttcacataagttacatcttcttatcctttaggtcaataattcagggcatatattactgtatggcagaggtctttggaggatactccatttaaatcagccaacccctaaccctaacctcagcaacaaattctctcacatcacccagttttatttctttcataacacttactattctctgaaattgtcttattgtgtttagacacacctccccaaatactctacacagacacacacacacgcacacacaaacacacacagctaacacaatagaatatccttcattatagcaagcaccctgttatcttgtttaccatgaaaatccccagttccaagaacactgctcagtacctaggaggtgttctataaaattgtgttgaatgactgaatcaaaaaagaaatggataaaagtggagaatcaaactgagtgtatatcatttgtgtattctgaagttttatcaatgtttagaaatgctcacaaataaagaatgttgaattacattctgatgaatattaagaaattcataggtttaatccaaactattgaaatatggaaaacattggagatgttttcaagaaaatataatttgttttgaaattgtctgtcttttctaattttatgcaagatttgcttctcacttgactaggtggcaagcatggtattagatttgtaaagctttttagataagctttgctttagaattgcaaaatgtacatgttttattcatatctagtgatctggtaggatgcaaataactgacatgaaacaactatgcagagtttaagcttgtaggatcagatctcaatggattagtaatggtggtaaatagagcataaggacaacatgaagaagtaaaagtgctttaaaagataaaccatagatgtcaataaatctaacacttttgattaaataatattgatatgatattcatcctagtttgtaaaaatgagccattataatttcaactgaattttacagaaagaatgtgtcatctgagtaatttttccaagtatattgtgaaaggttttgctagaaattgaactgaagatgaactacttttgtattttatccttatgtatccttaagtattttattgctaaaatatgtgtctattaaatcaatgtactcaatgtacatctctgtggaaatcttctctctgtacctaacctctgatatgttttctgaaggatgaggaagatggagagaatgcccacccatatagaaacagtgaccctgtgattgggacccacacagagaaggtgtccctcaaagccagtgactccatggatagtctctacagtggacagagctcatcaagtaaggctaatgaatcagggacaagatcctgggtgtgaggtctgggttaaattaattaaaaaacaacaagttaaatcagccacaaggttccagctacttgataagagaaatggtaaaaatgtaagatatattaaatctatatagagttgctattgtttaaataatacataatatatttgacacagtcatatagtgtgtgaaaacttttaacactgtagtcaacggggctcctcgggatactcctcaaaaaagccatattaggagattaaacctgcatctttaaaataaacacctttgttggagtgagccacctttatcttgagtcaacatatttcaaaatgacttgaagtattcagataaatgaaatttattttctgctccattctctgtctctttctttctcccttcctcttccctgcgtccccctcattctttctcccccgaccactttccttttttcctgaagtactctgaaaaatgtagcacatttgcatcaatttacttttactgacatttactttttagatcttaacccagcattaatcagtaaagagtgaagcaatatgcaaataataaatggtaggactatgaccaattaggtggcaaaaagggatccaaagtaaccaacaaggattttctaatgaagattaatattttttctaagaaggaaatcactcaggatttagtcaaatttccagctacaatatttggatgaaacgattgatattgcagggtgccttatgactttttgtatgtagactgttatacatctctctaatcttttcagggtttttaaatgtttttgcaaagtttgtttcccatttccttttaaatcaactgcttctgttatctgaagatgtatggcaagaccagatgtttcaaatatcctgagttttattcctattttcctattggctgtagaatagttattttgtgacaaaagctaacacagaaacatttaaaggatgttttttgcatgtatgaaattcagatctcattagtattaatttctcctggaagtttaaaaactctatattgtgatgctggatgtggggagaattttattaactagaatggactgcgaaaagccctggtctggagttgtcatggaagggagggtgtgaagagatggtggtccattttaccattactgtataccacttaatttatgtgattagatgcaactcatctgtgttttacatcagttcacatacaatgtggagcatcttgaaggagctataccttatttccacaatgcatggtagtgaaacgtgggctattccctcactgaacagagtgatgaaaggcttgactgaaggaagatgtgaagtggtgactgagtatgagggtgggggaggagaattacttccactgggagccattcttgttcccagacaggtgacaaaatgctatctcttttctctgtttcctgaagtttaagatcaaaaataagaggaccagacaacaaggatttggagcagttttaaaggcccagtttagaagtttcaaaccacatggggatgcagatattcagacacactttctccttcccttgcactcatacaacaagcaaaagtgccacctgttatgacagaaatattgcctcaaaatggcctttggtacacagtgggaactctggggaggaaattgtagggaactttgtaatgtgatgcttttggcaagtgaccaatacttagtacattgtgcactggatccgattacggagactgaagtgagagggtacttgggttagtgatagaggagagtggccagattggcaggaaaaaggttcgaaatggctcagaggacagacgtcactgatggagagtaactggaagacagacaccaggatgggtcaattagaacttcctcaggagcctggcatccagtgttccagcattatcaatacttagttgtgtccagatgatgattcagaatgttataagtcttccatgacaactgtgaacttctgctttcatcaggtggcataacaagctgttcagatggtacaagtaaccgggacagctttcgactggatgacgatggcccctattcaggaccattctgtggccgtgccagagtgcatacggatttcacgccaagtccctatgacactgactccctcaaaatcaaggtgagaggacatcatatcccaccttctgaatggtctgtcaaatgctgattatatgatctgtttcagcaagtataagcagtgggaagacagtgtgagtgtgttcttcccaacagtagaagtggaggctagcttacagtactaagactttttttcttttttttttttctttttttgagacggagtcactctgttgcccaggctggagtgcagtggcgcaatctccactcactgcaacctccacctcccgggttcacgccattctcctgcctcagcctcccgagtagctgggactacaggcgcccgccaccacgcccggctaattttttgtatttttagtagagacagggtttcaccgtgttagccaggatggtctcaatctcctgacctcgtgatccgcccgcctcggcctcccaaagtgctgggattacaggcgtgagccaccacgcctggcccagtgctaagaatttgaataaaatatgtgaggtggagtcggggtatcagtctgttcaggctgttagtgtaagttgttattatgtagatgattcaggttcagagtctatcagggaggaaggaattctctccattttcctgaaaaccaaaagcctcacagttgctgaaggtgcccaactctgcctgatacttgcaggaatagaaataatgaagagagagggagacaaggtgcaaatgtcaggcgagagctgagcagagcaaaggccttgggaaccagacttggcagggcaattccagtattttttatttttatttttatttccataggttattggggaacaggggtgtttggttacatgggtaagttctttagcggttatttgtgagacccatcacccaagcagtatacactgcactctatttgtagtaatttatccctcaccaccttctcaccctttccccaagtccccaaagtccgttgggtcattcctatgcctttgcatcttcatagcttagctcttgcttatgagtgagaacatacgatgtttggttttccattgctgagttactttacttagaataataatgtccagtctcatcttggtcactgcaaatgccattaattcattcctttttatggctgagtagtattccattgtatatatatacaccatggttttcttttcctttcctttcctttcttttcttttcttttcttttttcttttcttttgtttttttcttttttgatggagtcttgctctgtcaccaggctggagtgcagtggcacaatcttggttcactgaaacctccgcctcctgggttcaagcgattctcctccctcagcctcccgactagctggaggccaccgcacccagctaatttttgtatttttagtagagatggggtttcagcatgttggccaggatggtctcgatctcttgacctcgtgatccacccacctcagcctcccaaagtgctgggattacaggcatgagccaccacgcccagcctataccacagtttctttatccactcactgattgatggtcatttgggttggttccatatttttgcaattgcaaatcatgctgccacaaacgtgtgtgcaagtatcttttttgtataatgacttcttttcctctgcatagatacctagcagtggaattgctgaatcaaatggtcgttctacttttagttctttaaggaatctccacactgttttccatagtggttgtactagtttacactcccaccagcagtgtagaagtgttcctttttcagtacatccatgctaacatctgcaattttttaattttttgattgtggccatacttgcaggggtaagctggtatcacattgtggttttgatttgcatttccctcatcattagtgatgttgagcattttttcatgtgtttgttggccatttgtgtatcttcttttgagaattgtctattcatgtcctcagcctactttttgatgggattgtttgtttttttttcttgttgatttgagttcattgtagattttggatattagtcctttgtcagatgtatagattgtgaaaattttttcccaccctgtgggttgtctgtttgctctgctgactgtttcttttaccatgcaaaatctctttagtttaattaagtctcagcaatttaactttgtttttattgcatttgcttttgtgttcttggtcatgaaatccttgcctaagccaatgtctagaaaggtttttccaatgttatcttctagaagttttatagtttcagatcttagatttaagtcgttagtccatcttgagatgatttttctataaggtgagagttgtggatccagtttcattctcctacatatggctagccagttatcctagcaccatttgttgaaaagggtgtcctttccccactttatgtttttgtttgctttttcaaaaatcagttggccgttaagtatgtggatttatttctgggttctcttttctgttccattggtctatgtgcctattttttttttttttaccagtaccatgctgttttggtgactatagcctatagtatagtttgaaattaggtaatgtgatgcctccagatttgttctttttgctcaagtttgctttggctatgcaagctcttttttggttccatatgaattttagaattgttttttctaattctgtgaagaacgatggtggtattttgatgggaaatctgttgaatttgtagattgcttttgacagtatggtccttttcacaatattgattctacctatccatgggcatagaacatgtttccatttgtttgtgccatctatgatttctttcagcagtgctttgtacttttccttgtggaggtctttcacctccttagttaggcatattccaaagttttgtttttgtttttgtttttgcagctattgtaaaaggggttgagttcttgatttgattcttagcttgatcactgttagtgtataaaagagctactgatttgtgtacgttaattttgtatccagaaactttgctgaattcttttatcagttctaggagcttcctggaagagtctttatggttttctaagtaaatgatcatatcatcagaaaacagtgacagtttgacttcatcttcagtgatttagatgccctttatttctttctcttgtctgattgctctggctaggacttccagtactgtgttgaagaggaatggtgagagtgggtatccttatcttgttccagttctcaaagggaatgctttcaccttgtgcccattcagcattatgttgactgtgggtttgtcatagatggcttttattatattgaggtatgtcgcttgtatgcctattttgctgagttttaatcatgaagaaatgctggattttgtctaatgctttttctgcatctattgagatgatcatgtgatttttgtttttaattctgtttatgtggtgtatcacatttattgaagtgcatatattaaaccctcccagcatccctggtattaaacccacttgatcatggtgggttatctttttgatatgttgttgaattcagttagctagtattttgttaagaattttagcatctatgttcatcagggatattggtctgtagttttcttttttggttaccctctttcctggttttggtattagggtgatactggcttcatagaatgatgtagggagggttccttctttctctatcttgtgggatagtgtcaataggattggtaccaattcttcttcgaatgtctggtagaatgctgctgtgaataggtctggtcctcaactttttttgttggtaattttaaaattaccatttcaatatcattgattgttattggtctattccgggtatctaatttttcctgatttaagctaggagagttgtatctttccaggaatttatccatgtcttctaggttttctagtttatgcatgcaaaggtgttcgtagtggccttgaatgatcttttgtatttctgtagtgtcagttgtaataccccgtttcatttcatattgagcttatttgaattcttactaatggtctattaattttattcatcttttcaaaaaacagctttttgtttcatttatctttcatatttttttgtttcaattttatttaattctgctctgaccttggttatttcctttcttctgctgtgtttgagtttggtttgttcttgtttctctagttccttgaggtgtcaccttagattgtccatttgggctctttcagaccttttgatgtaggtgtttagggctatgcactttccccttagcaccccctttgctgtgtcccagaggttgtcataggtcatgtcactattgttgttcagttcaaagaattttttaatttccatcttgatttcatttttcacccagggatcatatatttgcatggttttgaaggttccttttgcagttaatttccagttttattccattgtagtctgaaagagtgcttgatataatttcaatttttttatatttattgagattcattttatgtcctatcatatggtctatcttagagaaagttccatgtgttgttgaatagaatgtatattctgaggttgttggatggaatgttctgtatgtatctgttaagtctatttgttccagggtataatttaaatccattgcttctttgttgactttctgtcttgatcacctgtctagtgctgtcactggagtactgaagttccccactattactgtgttgctgtctatctcatttcttaggcctattagtaattgttttacaaatttgagagctccagtgttaggtgcatacatgtttaggattgtgatattttcctgttagacaaggccttttatcattgtataatgtccctatttgtctttttcaacttctgttgctttaaagtttgttttgtctgatataacagtaactattcctgctcacttttggtgtccatttgaatgaaatatctttttccacccctgtaccttaagtttgtgtgagtctttatgtgttagatgagtctcttgaaggcagcatatagtttgtgaaatcttatccattctgcaattctgtaactttcaagtggagaatttaggccatttaattcagtgttagtattgagatatgaggtactattccattcatcatgctatttgttgcctgtatacattttttttggttttttgtgttttttaaattgtatttttgtttgataggtcctgtgagatttatgcttcaaagaggttctgttttgatgtgtttccaggatttgtttgaagatttagagctccttttagtggcttggtagtgacaaattctctcaacatttgtttgtctgaaaaagactgtatctttccttcatatatgaagtttgattttgctggatacaaaattcttggctaataattgtcttgtttgagaaggctgaagacagggtcccaatcccttctagcgtgttgggtttctgctgagaaatctgctgttaatctgataggttttcctttatgggttacctggtccatttgtctcattgctcttaagattctttcctttgtcttaacttcagataacctgatgacaatgtgcctaggcaatcatctctttgcaatgaatttcctaggttcgtgtttcttgtatttggatgtctagatctctagcaaggccagggaagttttccttgattattcctccaaatacgttttcccaacttttagatttctcttcttcctcaggaacactgattattcttatgtttggtcatttaatataatcccagacttcttggaggctttgttcatattttcttattctttttctttgtctttgttggtttggataatttcaaagaccttgcctttgagctctgaatttctttcttctacttattcaattctgttgctggaactttccagagcattttgcatttctataagcatgtccattgtttcctgaagttttgattgttttttatttatgctatctatccttgaatatttctcccttcacgtcttggatcgttttttggatttccttaccttgcgcttcacctttctctggtgcctcctggttagtttaataactaacctcctgaattctttttaaggtaaatcagggatttcttcttggtttggattcattggtggtgagctagtgtgatttttttgatggtgttaaagaagcttgttttgtcatgttatcagagttggttttctggctccttctcatttgggtagtttctgtcagagggaaggtctaggactgaaggctgttgttcagattcttttgtcccatggggtgttcccttgatgtagtactctccccctcttcctatggatgaggcttcctgagagcaatctgtaatgattgttacctgtcttctacatctagccacccaactagtctaccaggctccaggctggtactaagggttgtctgcacagagtcttatgatgttaactgtctgtgggcctctcagctgtggatgccagcacggtatttagattgtctcctgtttactgaaggaggaattcacttccttcaggggatctgtgagtcctcccaggtttcctaatttatttctgcaatcgttctggagccaaaattcatcatgtgagcatccacacactcctctgctcgagttggagctgcaatctggtcctgcctgccgtctgccatgatgccccggaaatgtctagtactttttaagttggttgctatgagtaaccagagacctttctcctggtgatattccctcctgaattcccccttcttactcttatcctctgtattcattctctattgctgtgtaacacattacctcaagctcagaggcatcaaacaacacaaatgtattgctggctcacagtttctgtaggtcataattatgggctcaactgaattctaagaaagctgtgatctcacctgaggctcagggttctcttctgagttcactggcttttgacagaattcagttccttgtggttgtaggactaaggaccccattttcttgctggatatcaactggagtccattctaagcctctagattccaccagccaaggccctctctacaatacggcagttggctctttcaggatgaacaggaaaaagctcactcaggccttaatctttttttttaagggatcctacctgatttgtcagacccatcaagataatctccctttcagttaactcaaaatcaaataattcagtacactaaatggatctgcaaagtccctcctattatataagggtaacataatcatgagtgtgatatccatcattttcatagtcctgctcacactcaaggagaggggtgagttacaatagcacaaagagaagaaggttttgcgctaaaagaattcatagatgttaaattattcctttctagtatcacaaagtgctaaaagtcaaagggcataaagtatgaattttctatattgttaacactaaaccaatgttaactaataattatgatatattatggagtatttatattattatttaacatttaaggtcttcagcccttctcttgatcccttccatgctattaaatcagagtgagctcaactggagaattaaaaatgcactgttccccacagtaagctccttagttatgtatatggaatgatctgatgtctaagttcaagtcttggggaaagggtacccataacctagtaaccattgtgggagagagcagtagaaggaaataaacacaacacagtttgactcaggatagtctttcaacttccgtacaataccgtgccaagggaccactgctgctgctgcctgaggtgagtttttgtggagctcttacaggacacaacaggaattccccagttacccatgaaaattgaaatactattatttccatcaagggtcttatccaaaatgaaattgagtctttgcttgatgacctgtgggctttcctggaatgcacaggtatatacctttaaaggataaagttgcaaatttacaagtttcaaggataataggaaggatgcagtgaagggtttccatgcctagaaactttccagagcttcaggagagcttctcagtctccctagctgataccatccaacctatgatttgattccctttcattaaaggcagaaagcctaacagatcacaggactagacagacagatgatcacaagatagaccagttagttcagtcatggtgaattataccattacaagtaaaatttgttttttagatggaagaacacacattctcagagcagcaggaaaaaatatttttagtagcaggcttgatgcttagtttgtttgaggatagacacttaaaaagggcaaaaatattagaatctgtaaagtcctctctggggcagaaagttttaagtctcaaaggaggaactataactcttgaacataggcatcctatttgcatagaaataaattttctttacaaataaatatccccatgaggttttctacccttgccaataactggcagcctatagttaattatggtcttagatgtgagtaaagaaaaagaccaattggtttgtccatactaatatgattcattcatacttcaatctaaactttgctgtgagctcaatctaaatgttatctcttcttaataagaggagagcatgaataccttaaaaagaattaagtagcataatttatccttagtgtacacatacttttatgtgaattctgcaaaatttctttattttagatgaatgaaatacttgaaatgggtttattttataccatagataaatttttcagatgcactagaaatatatagagtaacagacttctctttcatctccttccccagctagggagcacctcctggaatgataacttgagctttgttacatatatattactttgacagtataaataaaaagagcatcaatttttggttaagataacttgaacttgagttctggttctgccgttaacttcctgcaagcttttgagaagtcgtttaatatctctgtttctttttctgtaatatctacattaataatgatgatacctcctttatgtatctaagaagtgtgttgtgagcaaaaataacttagagtaggcaaaagtgttttgtaaattatactgcagactctacagttataagttgataaattgatacaataacagaaacagaaacatgtcatcaaactatgtgagagctttttgtcaagaatgttgaagttttcttcattataactagtaagtaacttctttgaattttttttaagataggatctcactgtgttgcccaggctggagtgcagtgacatgattacagctcactgcagctttgaactcctcccacctcagtctacagatacatgctaccacgccaggctaattaaaagaaaaaaattgtagagatgggatctcactttgtcacccaggctggtctcaaactcctggcctcatgcaatcctcccgccttggcctcccaaagtgctgggattataagcatgacccaccatgccaccagcctgaacttttgaagcaagtgaatgtttagatttgtttctgttatatctgaacccctttagcataatgtcctcattattctagttttctatgatttcattctttctatcagtgaggttctctgaaatctaatgtgtatggatttctttgcccttagaaaggagacatcatagacattatttgcaaaacaccaatggggatgtggacaggaatgttgaacaataaagtgggaaacttcaaattcatttatgtggatgtcatctcagaagaggaagcagcccccaagaaaataaaggcaaaccgaaggagtaacagcaaaaaatccaagactctgcaggagttcctagagaggattcatctgcaggtgagcaaatctgtgttctgtttgcttttggaagcatgtaaatggaaacaccgaagggagtggatcagtatttgtgttgcattgcttaaaaatacaagtcttgcaagcaaaggaaaacctgttttcctagaagagctcttatttctcttttattacttttttatgcaaggacaagtcttgatataatatcccttggactataccttaatagtatttagcagtgacaatagagattgatgttgagaaaatgcagtgaaaaatgaaaaatatctaggagaataaaaagccctaagaaaatgtctaaacgagaatggtaaagagagtataaggaataaagtaagtctaaaaaagtgaaaggaaaaatgagaagggaattgtattttctaccaagcagagatcaaaatcaagttgagagaagataactgaatataatcattttaaaagtaatttgagggaaacggtgatcatcaagccgcataatgattgtgttaaggaaactgtgttgtctgtatctgtaacccaattatgattttcttgttatattaccaaaattcttttgaaatatctaccttgttaaatagtgtgtacatacactacacctagtatcaatgaatttacagttttgcaatccatttctaaaattaactcagcagcactttgatagttttcaaaattcaccaagacaatagccaattacacttttcttaattgtttttttctgaattatctagttatgttcctgtctgtaaacacactatctaagccttcctatattactcttggtgcacctcaaatgggatattcctatgagaatgtacgggttagcatcttgcctctgaatcttgttcattgtgtgacctgtgagaaaaccaaggtctatgagactgaaatgacttccccaagaatgcacagttaaatggttatatgtcagaacaggaaattttgtgttctttattctaattcagtgctaagaatatacttttttaaagaaagaattgtcattcttcttgcttttcttccttttttttttttttttgttaaaaaggggtggtcataagttctccctgattacttaaaacttttagacttcctcttattctattttagtaattaaaataaggatattgaaattagagcaagtaaaataggaggaatctgaagaagttgaaaaagcactcaacttcacttaatatttttattttgtttgagaggatagaggtttcaaaataacatacagactttgaaatcggaaacctatgaattttaaactaatacatattgattcaaatgacggacaaaatatacatgctgagaaaacaattctttccccaactacagtgcttctatgcttagtaaaagcttccaattaaatagaaagtctccaattcttttggtttacataatgcctttcaatcaaaatgctacacccacttttttgtatagaattacatctgtttcaaactcattttttaacctaccccaagaatgttttgagagtagatgcttttgcaatcatgaaaacaagaagagatgtagattctgaaatattgctgtagcatgctactctgctagaggcattttattgatagacttaaagtaatgctagttctgtcaatttagttagttgagaagtgaaacatttccaaatgggatgcatgatccaactatttaatttatccatgatttggaattgtatagcttaaggtaattatttcttctttacatttggccttccaaaaggcgagaattatacaacataatcatttaagagccctggagttcatatgtcagaaacgaatacaagtgaagttaagtaaaagttctattggcacctttggtccccatgtgcatctctatactttctttaaatctaaagagaactaaaaataaaatatttgaatctgactaatttgctttatattttttgtcttacaggaatacacctcaacacttttgctcaatggttatgagactctagaagatttaaaagatataaaagagagtcacctcattgaattaaatattgaaaacccagatgacagaagaaggttactatcagctgctgaaaacttccttgaagaagaaagtaagtgtgtacacctactcttctccccagctgataatcagtttaatgtaaatagtataatcattagaaacaaagccccagttttatttactgagatcatgaaagcacgctttcccataaaataggtattttcatataagtttgaaaacaataactctggtcaaatatgtaattaggaaaaggaacttatttccttattggactcaggaaatgaaaggacttttctgggtacctcatttccactctgcaaagctattaatttacatgcaagtggatgcctgcattcccaaagactgagggagttagagacaagtatttagtaacagcataagccattagtgcgaaatgtcacacatggcttctgtagaacaacacgaggctttaagataatgagccttcatggcacacaggaaaactcattttatgaccacatagtcacatcttgtacatgtttatagtactctttcaaaatgttataatagcttgcaaaaatattcagcactcacttttattatctgagatggttctctgtatttgtaagtattaactgaagatgaaataatcttggagatttacagaatattgtctacagcaaccaggcttgtaaagataggatagcttttattttttataattatccatccagactgcctttcctgccaaatccggtcaggcccccaaacactgacgttagggtttgccaaactctgcaaggagtattttgtgagcaaccaaaaggggaaagtctaactttaaagataaaaaggaacttagataatcaaatccagccttctctatcaaaaaatactactactaataataattactagtattaatattattagtttttgagatggtgtctaaatctgctgtcccgggtggagcgcagcggtgcgatctcggctcaccgcgacctccgcctcccaggttgaagcgattctcatgcctcagcctccgagtagctgagattataggcatgccaccacacccggctaatttttgtatttttagtagagatggggtttcaccatattggccagcctggtctcgaactcctgatcttaagtgatccgcccatcttggcctctcaaagtgctgggattacaagcgtgagccaccgcacccagcagtaaaaataatactagtaattattaactacatttttaaaacatatgtgctctgagcaagactctgggccagggtctttcctgattattctcttgagtacttaccccagttctttgagttagacactaccgccctcatttttatgatgagttaagacagcaagtaacttgtctaagaacactcccttagtgaagtgtagagttaggattccaacccaatgtatgtgctgctgtgttatactttctaacactacaagtaacagcccagatggagagtgaggagggaggaaagcgttatttagggaccaggcctcctgattgtccttttgtgggctattctatactctctctcataagtcccacaaaactgaggtagagcacacgtttcctatacactggctttttatctagtgaaaagtagtttactttttaagaaactggtttttactttattcttatcatccttttccaagagctttcacaggcataactaatttgacatcagcagaactgatttcatcatcaggcctaggttattatatgctttctttgaagttgtgaggctgggagatgcaaaagagagggagatgtggtcacagaggcagacaaagttcaagcttcagaaagtagccaatctaatcaatatttcaagtcaagacaaaattgatcagtgtaaacagatatagtaagttcgttcaggtaaaggagtcagtttcattcacatcttgtcatttcaagacgtggctcctcactaaacaatgtttggcttagaagtagattctatagagttttattatggacaatgtccagtgtcattgccaatactctccaaaatgatttgaccatgaagtacagggaggagaagagtattttttgaacacttgtaaatgattgcttttcttccataatagcacacatctaggtattttgcccaatttgcagatgaggcaaaaatttggagatgaatttcaaagaagtcgaacagctagatgagtgcagagatggagatttaatcaaagggagtctgctgtaaaactcctccacatgtgcaaattggccaatatgaaagcaatgaatatttgaaaattgaagttttctgctacttcaccaattttctcaagggctttgattcagttttctatatcagaaggtaaaaggcgagaggcttccatggctgcctgtcaacagggtttgtggagagaaggggctgggaacctgggcaagcagcactttcagcaataaacagtatcctcaggggcccacagagggaagatggtttcagtgccaaaggcttgagtccccttaattttttcattccacttcactcatcacctgtctcctttctatgctagcaaaagaacaattattcatagatggtaaaattatttatagagccgatgtaattaaaaagaaaaaaaaagaaaagaaacacctgatgcaaaattcttccattgcaaggtgagaagatgaaaatccaagtagctaagtggctttctcaagctcacaaatctataattcagtctcttacatctatcagaaacatgttccgccttatcctggtctctgaaaacaaaacatagtgtctccaaagcattaaatggtttttgatgtttgatataaaaaaggacatgtcccagaaattattcccctgcataaaactttagaaaatgatgcttgaaggtcactagaagttgattacttaatgacagccagtaaggtacaaacatacacagagccaaattctgggagatgaaaaatggaaaaaaaaaatacagattcaaccagtgcttcttgtcaacacactactctgagatttttcttattttaatcttatggtctagagtagtattagaatatacatgtcaaaaagatgcatattgcaggttaggctattctgactgaaagctatttatcttttatgaaactgctttgctcaagaaataaagaagaatgacttccatttgtcaataagatgtcgagttctgatgatttggcaccatactggctgcatgcttatttttatctattttctactctgtgaatcatatctcctacaaccatgctaaagattaaacacacaaccttcctgtaccttgaatgataaagaccttgagtatatggttatataaaactgagacatttaaaaacaaatgcatgtcacgttaaacgttaaaaatagtttgcctttctttttaagaatgggacatgtaaattttctaggatattatggatgcattttattttgatcattgaatgatgtcagtttgaggaatggcaataaatttctagtttggtgtttcattgttagattgagaacataaaaggatttgctttgctaatcatgcaatataaaagttgagcaaaatgggcacatatcttgaggataagagctaaaattttgagataatgtagaaaagacaagtcctatgtgagtcttaaatatatctagagagaccaagaggatggggtacaaaacagggaaaaaaaccagacttctaagttttaaagcaagaatttttccttttctcttcttagcccaagatagatagcattgtacccactttgaccttgaaaatgtaaactggattacacttttttttttttttgtattgtactttaagttctgggatacacgtgcagaacatggaggtttgttacacaggtatacacatgccatggtggtttgctgcacccatcaacccttcatctacattaggtatttctcctaatgctatccttcccctagccccccaccccctgacaagcagtggtgtgtgatgttcccctccctgtgtccatgtgttctcattgttcaactcccacttgtgagtgagaacatgtgtttggttttctgttcctgtgttagtttgctgagaatgatggtttccagcttcatccatgtccctgtaaaggacataaactcatccttttttatggctgcgtagtattccatggtgtatatgtgccagattttctttatccagtctgtcattgatgggcattagggttggttgcaagtctttgctattgtgaatggtgctgcaataaacatatgtgtgcatgtgtctttatagtagagtaatttataatcctttgggtatagacccagtaatgggattgctgggtcaaatggtatttctggttctagatctgtgagggatcgccacactgtctttgacaatggttgaactaatttacattcccactaacagtgtaaaagcattcctatttctccacatcctcttcagcatctgttttttcttgactttttaatgatcctgattctaactggtgtgagatggtatctaggtcactgcttggtgggaagtaaagatgcttctccaacaagctgatgaaagggctggtatgtggcgttagtgctgatcacaggattacctctggaggaggataaccaccctggggttctgcaatcccagcaagaccagcatagatatttggaatttgctcctgtgttgcatttaaactgagaggaattaggtcatcggttccctcaactgggaatctagataaggttatagggagaagaaaaattggagtgagatgcagctcttgaagggacaagagagcaggatctgtttattttgtgcacatttaggtttttctatttattatctgaatttaaaaatgtttcatttactttggaagtcaatattcccaaataaaaaagagaacagaaaatatgtgtgtgtgtgtgtgtgtgtgtttccataaacacaatcttcaaggcccctttgccttactctgaagtcctctttagaataataagctggtttactgttgtttatagtaaacatcttgtctttattctgcacttgttcctcatttttcacattcagaagcactccaatgtgtcttaaaattgtgtctatgagaatgtgtactattgtccttggggaaaatgggtgatggaaataccttgtttgctctagattacagggataattaaatttaaaattgaaaacaaagtaacagaataagcaaactttacagaatctgtatacaatgcatttgaggtacctgcaaactctggttgcagtgccaaatgaggaggaaggggaaagggtgggttgtgtgccagaatgttgataccagctgtggtcacagcagcccctcattgctcaagcatccccagttgtgccttcctgcctgcctgcctgcctgcccaagtcgatgcagggcaaatggcgggccgcagccaggagcctggaacacgagctgtcagcaggggagatttgtatttatgccaagcagcagtccagcagttggcctaacagtgtgccagcatagcctgggcctagcccctgacatgtgtacctggagtttccaacccacttgccatatgatttgcatctagattcaagaaatctacagctttaaagaaaagctatgctacctgtccacacaaagtagagaaagcatgcaggcattttacttgtatgtatttaatatctatagtcatagttgtttgccctcatgcaatttaatttcttcagatttctttttaattttacctccaaactttcatttatgatggatgccatattctatatcatacaaaaaactataaaataaagtataaggattctcacttttctaccagaaaatttccagtgaaaagtgttcacagatttttcactttagtcacataaggacctctctaatggccgtatatatagagcactcctgtacctgtgtttatattgcactgggattgtatacaacacatagctttgtaatgattaccctggccaaacaagaccgaatcttctattaccacatgctttcccaaagcccctagtcctgtgctttgcattagtggatggttaacataaaatgagtaaatgatgaatgaggaggtcaaaagatccccaaatagtaagtcagtattctattattataaaaataaagttgcctgcaatcccacctcacacatacaagtatttgtaataagcagatcggtattcgagtatgttgtcaagattagtttatgaatatgctaaccatgcatgtgtgcaagagtgtaaataagtacatttttggagggcaataacgtgaaacacaatcaaagtttaaaatatgcacacttttgtatccagaaattccagttctaagtatttgtcctacaaaattcaagatacgaatgcacaaaaatactaactaaaaatctagtagttttgggtaaaaactaaaaacaatagggacttccatcaataattaacctgttaaataaattaagatatacccaaacaatgaagtagttttgaaggtgttatgttaaaaaaatgatatagcgtgctgtttactgatattaaagttttttaaaaatatgttaaatgtgaaagcaaattgtagatcactaatatgcacagtattcctatttttgtcaaaagtaatagttttagacataatgaaattagattagttttttatcatatctatatagggaaggcaaaattttatctctaccctcttaggcttttaaaaacagctgaaaattaaattgacataggacagaccaacaggagaaaatcacacaaatttatttaacacaaaattcatgtgacaagggaggcttcatgggaaatgaagacccaaagatgcagttagagttgaacacttgtatactgaattagacaaagaataataagttgtgaaaatgtgacaagtcacagaagcttgaaataggctagctaattgggtgaagtggttagatagataagggtttgtttaacatggcttgtttgtacagatttccctctgcctcaacttcctgtccttgatgataagaatgatacttttcttctggtagagggaaggtagctttcacatggaaatgtcatctgcttttaagaagcagaaggaaagtcagactaggcatggtggcttatgcctgtaatcccaccactctgggaggctgaggcaggaggattgcttgagtccaagagttcaagacgagcctgggcaacctagccagaccctatttctctctctcttaaaaaaaaaaaaagggaaagccagagtgatattcttgcacctgctctcttcaagtgccttcaactcaaaatagtcaatatgccagagcagcatattttggggtaatgtgttcttaactccttcatcatgtaaatgggtttaattaacctataagaaatatgaacttgactttccaaggcccctaattaaataatgtgtgacagttttaaacgttatttggtcattaccaaaatagtcagtacaatatgacaactttaactgaggagggtaaatatttcctgggaccaaagccctccatatggtgtatggttggggagagtagcagtctaatgagattgcccaggtaggtgctgagttatcgtgatcttgagtgagtatgcctctgcctctgctgaagttcctagcacagtggaagtggagattgccctagctgaaagcgaaaaggtttatttccaggtacacatctcgttagaagctaggctccaaaaagagatatgcaagaggaggggaagtcatttcaactccatatcttctcatggcctcaggggaacagaagccaccagttattttcctatgaatggaatcctattcttaatttgttgttgtgtttccaaaaggtgggttagtattcaagtgaaatgaacaccaaatattcactgttattaggagaattaaagtgttcaggtaacttaagaatgggctttagatgaaataaaaaataactgagagacatgccatgttgtccactaaaatttcctccctggataacgctgcctctggacaaataaatatagccatagttacctgaacagtggctgggttttcatttgagtgactccagtgaggttaaaacttgagactgaggttttgagtcatcctaagatgtgtatccctgggttttgccactttggagatggccccaggatagagaaaaacaggaggatgattgatggagctgagaggtattctcatatgaattttaacaaaattccttttttgctctcctttagttccaatgtcctttaattcatctaaatatcattgtgtttattaaaaaattatttattgagagattcctttagccaggaattttcctatgcctttaaggttgtattattttacagtacttcacccaaagaaagctaaggcaagcaagatggtaaagacaaaatctggatgatttgggcaaagaaatctgggaaagtcaagcaaaaattagttttcatttttttgaatctttaattttttaatatgtaaaggtggggcagatttctcttcttagagtagaactttttcccagaataaggatccagttttatttccttaaaactatcttcacttttagtataattgagattgcctttcttaattaattaaatgtcaaaattccaatataattattttgtgaataattatattagacgtcttctgttttcatcacgatgccacccttttctttcaacattgataactatcttaaaatgtttttacatgggctttatacaattctgtaacaattttggtaggaaataaattattttaatatgcaaattagctcttcatgataaaatatttcctaagtaatttttaaatgttattctatttttattatatagagtacagaattatacagctttctggagttcctagtatgcctgctgtcagctggcagcaataagaaagacccttattcaaattatttaataattcttcagtgtattctaatttagatacgtatgtcctttaagatatttacaaaccatttgggggctttattgaaaaattataccgttttaattctttcattaaaaacaatgtggatgacctgagaaatagagggaaaattaacaaatttgaacacttttgtttgtaagttatatgcgtatgtgtgttttcatataattgtaataatagaatacatgaattatgtatacttttttaaacctagcgtattatcagaaacgttttagtataaaaagatgcactgaaacatcctatgggaagtccataattttgtaggcaaacctgtttcttattccaatgtgttacttgcctggttagcccagatgattgaaccatgggacaaaactgatgaaggttatggtttcaatttctgggtaggccagttagctttactctgtttcatggccacatgaagggactaaatgacttagaaagaaaatgtggatgcattaatgtgaattcatctcctctgcaggaaagaaacacccataacacaagacctaggtttgtgccaatccctgtcattagtgtcaggatgaaaagaaacaagaagaggaaaatcttgatcctccaaatacaaaagtgaatgcgatatagctttcatctccgtaatataacataatgacctgcctttttatagttacagttgagagttccagctgatcacctgcctgaaattattgcaagcctggtaggaagcatttgaggagcacagtcgtgttttcatttcacgaggaaatcatttagcaaattactgctgttctgtaaattaccgtgctgcataactttcatactcagaaactattttctttttccataaaaattgcagatgaaaggtttctacaataaatgacctgtgtttaaaacaaaaccattcctagaatttagagaacatgatatagcatttctcatgtggaaataaaaacaaatacatttttgttactaatattacacaatgacatattctctagtaaagacagtttttaatttatttactttattccccattgaggtgaatgcacagaggcttctgagagtgaaataacaagctaaatatttatttttttaaaggaaaagaactaattttggaaattacagttcttaaagactctgcttcatatcctgaagagagccccacaattggtaatcaacctaaatagaacagagtgttgggaacaaacagtttttattatgccaagtcttgtttaggatatcaatgtgaagggaagtagatcagttcttttaattttgcattgaggtaatattggcccaaacataatctggggaaatgtggccttatccccacaatcattatgactaagaggttcacactccaaataggatgatcattgctgatgtggcagaatgcatacaaaagcactaattcctctggccttttctagaaacacttggataatggaacacagagctggctcatttcatttcagtggcaataagatagaaaagccaaggcaggatagaaagcaattcttcagagaatgaggtcccattttagtgctgccttttcattaaaaaaaagggcttagaaagaagagtgaatgactgatactcagaaagactagtgaataataagtaaaccctcccaaacttaaagattgtcatgaataatgcacacaaaatgcttccatggtagctaaaatttaaaaataacaatcacaataggtgcctattaaaattgtcatcttatatctagaactagttataatatcactaggcaaatacctgatatttgaatctatagttaaaattgtggggcaaatgtgaagattcagaagaatggcataaatatggtttcactgttgcaaatacaagccttaaggaaaaggttaaaagaactgttatgactcattctgaagatgagcagactaagaagcaatttttatcattttcttccagcctttctcaaccagtatttttcttctaaactacagaatttaggagatattttaagtaacacttttcaatttctcccatggatgatgcttaactagtaccattctataaacattaaagagaagttaattcattaacacaagggtaacttacagcacaattctcatttataatggaagttgatggcaattggacacacagtggatcataaactaatgttagcaaaacatatggaaactagaaaatgcattttaaagaagatagatatatatatataaaaaataaataagataaagagtagatttcctagatataaattaattagcattataatagcctattgaagaaaattatacattttccttctttgaaggattctgaggtttggatttactttattctcactggaatgggatgaagtgcaaagcctctgtaggcagagttcttgtcccaaccttaaatgtgtgtttggctctttcaacgtggagctattcaaatgcctacagtggtgaagccccaaggttagaaggggaaagaggaagatatggtactgcagctaagaggcagtacctgagatctatttcttctctgaggagctcagctcaggatgcagaaacacccatcaagaaaccacatggacagagagaaagttgacgctaaaggaatcgagaagagtaatatgtgaacttcaggctgcttaggggttcttccaaaatatattttgttatatccctaatagtaatctttttctaaaagataatgcctgttgaatatagaacactgctttaagaatgcagaattatcaatctgaaaataaatgattattcttcaggactacagacaaagatatggaagactaaatattcataaagtagattcagtggaaattttggtgttttactttctaaaagcaacctggtttcttatgcctattttgtgatacatgcaaacataggaaaattctggatatttaaagttttattagttaacttccaaataattgaagtcctactgtacattcttacttatagtgataatttattaattaatctagattatcatgaatctaaaattgttcacaaagatcactattgacttggattgtgcatttaaactataaatgcctttttctaatgatactttaaggagtatttggacaaggcatcagtcacactgtggatacaatctgctttctctggcaacttattattaatgtaaaatgagagtccatattgatctttgctgatgcgggaagttcacatgaattccatgaaactgcaaatgaacaatgaagggcaaattttggcttctaataaaacagtagcttgaatatttgggtgcaaatatctcttttgtaataaacaaagataccttttacttgcagaactttccattgtaatgaagtcatggttagaacagttaaaataggataatacttgaaagtgaatgagtacatgaataagattttgtgttgctttacctaactcctgccctttttttccatttacagttattcaagagcaagaaaatgaacctgagcccctatccttgagctcagacatctccttaaataagtcacagttagatgactgcccaagggactctggttgctatatctcatcaggaaattcagataatggcaaagaggatctggagtctgaaaatctgtctgacatggtacataagattattatcacagagccaagtgactgaacacgcattcccaactatatatctacagatgcattccattttaactcttcttgagctaaaacgtcaaataggagaggaagataagataaatatttgtaaataaaacctaaagtttaaatgttttaatctgaataattgtacataaaattttgtatctctaacattccaaattactgtcaataaaatatatatttattattttaaatgctatgtgttaatatttcacttgcttgtattagaaaggcaaaatgtaagactttggtatgtgtgacatatgctttatttggctttattttacaagtacagtatctgcaaaaaacaaagtaaccttttttcatacctgccagttttgaatttatatatgttattgaacaaatagtaatagaggattcgctgttgaaacaagttgtccaagcaatgttatattcatttttatacttattgggaaagtgtgagttaatattggacacattttatcctgatccacagtggagttttagtaattatattttgttgatttcttcattttgttttctggtataaaagtagagataatgtgtagtcacttctgatttagtgaaaccaattgtaataattgtggaaatgttttgtctttaagtgtaaatattttaaaatttgacataccctaatgttaataataaaaagaactatttgcatattgcattttccagagtaatgttacttaagggttttaatattggactttagagaaaatatctcctcccagacacccctcactttttgtaatataagtgcatcccatagcaataatctcaacctcctcaaactcatctgtcccctgaaccccagtgatgtttatctgactcacttgataccctcaggaaacttcaattcaacataaccaaaccatcgattttctctacaaatttgtttctgcttttttattgccaactcctctttactgctactatcacccagccagtcatcaaagcagaaaatcacttcttgcttcatctcacatatatcctcctcatacaaattcaataagtaatcaagccctatggatcctacctctacaaatgctttcatattcatggccttctatccatttccatggttgttgtcttgctttggatcctcatgatctcatgcacggaaaatggcagtagctttccaactgaccccctaccttctcatccatcctccacacagcctccagataaatctttctaatccatgaatcaaatcaggtacttttctgcttgaaagttttggagggcttctcattgtctttagtataatatccaaacttccttccaggctgcataaggtcttccccaattgctttttacctaccttatgaattgtaactaccccctcaccaccaccaccatacacacacacctctcaatctacactccagccataacaatatacttgcaattttcttccctttgtgactttccatatgctatttattttcctggagtgtctcctgctattttccacattaggaagtctccctctttcctccatcctaaaggtcacttactctgtgaagccttccatgattccctttggtgctctcttctttgtgtttccatagcaacttgtaaattgtggttcatagcacttgtcatattatgctttatatatttgtatgacaattgcccttccgtaagactgtgacctccttgtgacagagattattttgtttagcctttttaatctctggtgcctaacataatacctggcacacagtgggcacttaggaaatatttgctagagggcattgaatatgatgattattcctatataacagattccatcttcctatttaaattgatccattcaatttatataggtactgtaggtaagtaccttccaaagtgacctattttttttttaaccaataaaacgtaataccttaggaaaaaacaggaaacacaaagtgttatttcaaatgctggaggacaacattacactgctaacgtccggcatatttttccagacccctgagatttaaccgcatatgcagtgcccaggtgaggctaaagcacatgtctacctctattcttcccccttcacagcatgaaatggtgtttcatttcagttttccaaggtgctgcctccatcatgaccccactcttgctacagctaccactccaaatcgattattctggggcctccttaaacacagcagtcactaaccatgattttaaaactttaatcacctgctgcctcagggagatcaagacaggatagcttctttatggagatgccaggaaattgtaagttggggagcaactaacaaactacttgactttaaaacggtggcaatcgcccatgacgcatactcagccacaacttcaatcacttaaaaatgaaggtctggtacccagtcaaggatttagggaaatgcttttgaggggaagtgctgcagagcccttgaggagattgaagcacaggaagagagattggattcctaaaaagaggagacaccatgaggctcaagtggtcaggaggaaggcctcatcacggagttccgcactaaaaaggacacaagaatagcggacgtatactccacattaagggagggctgctgtcctcaccttacccacagctccttacggatcctctgcagctctcgcctcagctccctcaacgtggggcagggaacatcaacagaaggaagacaggtttttctcttggccatggaaagctgaataaagagcagcggaaagataagaaacggctcatccaaggttgggaggtagctgaggaacttggaccttctgctgcttttggctgagtgagagacatgagtccaagccttttaagatggctaaaggattaacattataataattacaagatcatgatactggctttgtgtttctaggttgaaccctgacgacatttcccagtctcatatgtttatttattcactcagcaatatttaaagttggaacatgtatgctgtccaagactatgccaacaaaggtctttttaactatataaccgcatgagaatcatagcatagcttctctcattggaacccactgagtctttcatatatacacagatcagaatataccgttattctgatcccagagattccgtatctttgtaaattcaagtatgttgtgacaatatgcatggttagaggaattttattccagataaataaataaaatcctcatagtaattttttgatgaatacaaaaatcagatcatttaaattctgagttccccttgtaatgtacagatgaatatatctacattctgaagtatttcattataatcttttctcttttaatcaattaaattgccaagggagttagttcagaaataaaataacttttaaaatttcaaaatgataggcagctaaagattatcaggatttcagaaaacgtacaatttactgaggttacagtcaagtgccctgcaacttcctgaatgaggccaaattgatgacatttcatgttgagaaacttccgttacaagcagaagttctgagaaaaataataggaagaaattttagatactccatcacctcacacacgcacgcacttccatcctccccacaaccatcaaaaaacttgaataatttgcatacagacttcaagtactctttcataaagtgggaagtcacgctacaatcacgtaaaggttgagagcaaaacgaatagggactaaatgtaggtaaaagaacagcagcttctaaacttgaccaggttttttggctatggaaatgagataaaagcaaccctctttttatgttacctcctatttaactgccgaatttctctgatcacacccaatgttcacctaaacatagagactggaggagatcatggagttgaagcatctggtttgagaattgtgtgactgggcaggtcatttatcctctaagcttagtcttttttttttaatctacaaaatgttgtcaattaaatgagataatgtgtgtaaagcacacagcacgacgcatgtagtatgtgcataaaaacaactactgctattatatccactacttcatttttattcattgatgtctggacattcagtggaagcagtgcacatgctgccacaatgcaggcatggacttgcaggcatttgaaattcttaagacacaaattgtctcagagctatgacaactgtgtttgtcagaagcaatgagagagagtcagctggcttaagaggacttctcagatgaatgaccatttcttcatgaaagaatatctttgtttactcctaaccagcttacggagaggctgtgctatatttagctttcattcctcacacctagctcatgataggagtactcttttttttttttttttttttttttttttgagatggagtctcactctgtcacccaaactggagtgcagtggcaggatcttggctcactgcaacctctgcctcctgggctcaagtgattctcccacctcaggctcccaagtagctgggattacaggtgggcagcaccatgcttggctaactttttgtattttagtagagactgggtttcaccatgttgcccagggtggttttgaactcctgagctcagggaatctgcccgccttggcctcccaaagtgctgggattacaggcatgagccactgtgcccagccggagtactcatttttgaagaatgaaggatttataaataaatgcctaatgaataagtgaaaaaataaaagttttggggttattactgctattagtgcaccttggaccctggtctctgataaattatggagtcacaactcattgtgctataggcaacagagaagccctcaggaaggccgcctaaatgtagatatttacctatttataaagcttaagagcatttaggcaaataatctgccatgggaaatcgaagtgcagaaagaggctgagaagctaccaggaacatatatgaccttttcataactcttccttccctatcttcgtcatgcaaacttctcacatttgaattaccaacagttagagtatcagaaggtctgtgtgacataaattataagttaagaaaccatgagggaagaaagtaaaaaaatgacattagtatattcagtggtttcttttgaccttctggggtccctgatgggcctgagtgcaaagcagcatttcctcatagggcaggagtagaatcctgatgtgtaaggctaacaggatcatttcctttctgagttcttgggcactaggccaagtgaatgggcaggaatcattccagttgccgagtaaaatggggtgaaaagcacttctggcacactttgtccatataaattatacttgtttgcaattcatcaactccttctctcctttatatccatatgtaatgtaaatgatcatctttctctgaagctccataatgatgcaaagctcaaaaatgtgatagaatcagctaaaagagagcagatggaagtttatcccccaatatgcatattcataaaaaaaaatagagaactcaacaaaaggagatacataagtacttttacccgggggctgcatggacttctgtatgacagtaagttggttttctgcaactattcatttcggaaacctttactcattcgtttctgcagcagtcattgaaaatgctctgggaaaaaaaaaaaactgtctctgtaggaaacaaatatatttccctttggatttttattgcaccttagaatccgtgattcaggaagtaatggttaaatattttactagaaaaatataattagaaggcaaacaatgtaaaaaagtgaggtcttaagtgttcctttagcaatacaaactacagacgtttaaaagcacactgttacactgaaatagtgatatagggagaataatgaactgtctggatcacatttgtatgttttaaaaaaatatctgattactcaggggctaaggtggttcatgctggtgtactgaagatacagcaatgctgctagaaatttagtttagacaaagaaaagaaaagataggaaatggtaaatatatatatatacagccgggcatggtggctcattcctgtaatcccagcactttgggaggccaaggccggcagatcacctgagctcaggagttcgagaccagcctggccaacatggtgaaactgtataaaatcactggaagggtggctgtgagttttggtagcgtacaatgaaagaagtagcattcataccaaaatgagatgtttctgactctcctctccaatctactctccacttgtgaagcctggatattcactcagatatattcacctgtataagctactacattccagttctgtgccctgaggttcctgttgggctcagtgagcagaaagtcccctcattccctgaggagtgaggtcagggtatttgttttccctgtgagatcaccttgtgctggtgcttcccttaatcaaaggttgctagtcctttcaaggtgaccttttacatgattctccttccttgagattctagtaattgctcttcctcctgatctcttagggtctagattgagtaacagctctgtagctcttagctcccactaccagtgcagcccttattggttcccctgccctctactctgcccacacctttgtaattagtccctttataaataagccttcctgggatttcctaatttgattgtgtttcctgctggtagctgggcaagtacagtgatccaccaatgctcatgacctcatgacttctttttttttttgagacggagtcttactctgttgcccagcctccctggttcaagagattctcctgcctcagcctcttgagtagctgggattacaggtgtgcaccaccaagcctggccaatttttgtatttttttttaagtagagacatggtttcaccatgttggtcaggctggtcttgaactcctgaccttgtgatccccctgcctcggcctcccaaagtgctgggattacaggcgtgagccaccgcgcccggccatggcttcaaattacttaggccatgttcttgaaagcagtgagctctatggctccggtataactacacttacatggtctcaggtcatttttttctatttcactaccagccaccagccttgctggcaatcagtttgcttcaggaaaagaaagaaaagaaaagaagaggagaggagaggagaggagaaagaaaagaaaaaagggtaaagaatttccactaactccatcaaaattcatgtcttgtaccctttcaattcttaatccacctgtttcatggggcccagacatatacttctcctttttccaagaagctaagaaattctggaattggagtgactggcagcatataaatggaggttttcatgctgcagttcaggccaacctaactgcaattaacacttcttttctcctttactaataacaaaatccagtgtccactttactatgaaacacagggtcaattctattgggaaaatgtaccacccaacaatattaatatgcatccagcaaccatatgataaagcagaatgaaggaagtgcatattttaggctgcttgctacctaattagaaatatctgacattaatagcattttggagggtgtgtataaatatgataacacatagatactgaaattacattagcagtttttcacatctaaaattctttgattctaagttatacttcatctacagtatcacttgctaacatcaggctctcatacacaaactcttaggcctcttagtctcaaaagaggttgttgtaaaatacggatgtccagataatttgcatgattaatgaaaatatgttttagaatattaaacatttaaaatgttagcattcagtagactttctgacagaagttaaaagactattagaatgactgatgaattgctacagtacattagccctcagaacaaggaacctgcttgctagaggacatttatgtaactttttagctttcttgttttttcctttctctcccactctaactaaattgtccttatgtgaccttggctcagatttaaatggccaagcataggactttgcaaagttttgaccctgcaaattacatgaaaaactatagtcagagagggtgaaagaaagcagctaaattaatcagtgcttggtacataatatatctggcatatagtaggagattcatagaaatgtgttgaaggaatgaaacgccttctttcatgttgaggatggtcttacctcagcacagtggaaataaataaaacagaaaatctcttcctggttagtgacaaagtcactgacagttcagttgtttagatagggcatgtagatctacttacttttttccatgtgttaggatttgtatttccgaatgaagctcttcctactgtagtcttctagagccttttgtcttggttggctgcagagcttatcacgacctatttggtcatttgcttccctctcctgttatacttagagatgaaatatacaacaaaggactgtcagggaggtgtttacatcccctctgggtaaaaagtaaaagaccgttgaaaaggtagggccacaagaaatatcaaaataaattattaaggtagaagcagtaagcggcttaatggccttgctttgagggagacaattaacattactataatttatgggaagtattatcatgcagttatgagctccctctctgagccctacttgccaaagcctgcttctttaggcagtgttttcttgatagtgttatttagttgatagttttccaacactcaagtattacacagtatcattattcctgtgtcagggagtgtggagaaaagtacactagggtacatcatctagaatcccattacttagtcattaatgaaaatagtgggcagagcaagtgtaggaggctgaatcattgccccccaaagacagcagattggaatcaatggaacctcgtaaatgtcaccctatttggggaaatggtctttgcagatgtgactaaattaaggattttaaagtaaggagtgagtgggtccctaaatgccaccacaaatgtccttataagagaaaggcagaggaagatttaacccatggaaaagaaaagaccatgtgaagacagagcaaaaggagatttgaagatgctggccttgatcattggagtaaagtaaccataagcagggaaagctggaagccaccagaagctggaagaggcaaggaatggattctcccctagcacctctagagaaagtgtggctctgcagacacaccttgatgttagtccattgataaccgatttctgactgacctccaaaaccaagagagaattaatttctgttggtttatagcaccaagttggtggtgaatttgctgtaacaaccacaggaaactgagacagcaaataaactatctccagcattaaataagaggatcgttccccctattcttggcatttattagtagaccataggaaaaagtagattattagcagtaagtttaatacaaacagatataaacatccatatcccttaaaacttatgtgtattgtttctttctttctttctttctctttctttctttctttctttctttctttctttctttctttctctctctctctttctttctctcttccttgcttccttccttcctttccttctttcttcctttccttctttctttcttccttccttccttcctttccttctttcttcctttccttctttctttcttccttccttccttccttcctttccttccctccttccttccttccttccttccttccttccttttctttctttctttctttctttctttctttctttctttctttctttctttctttctttctttctttctttctttccttctttcttttttgacggagtttcgctcttgttgcccaagctggagtgcaatggcaatagcatgatctcggcctaacacaacctccgcctcccaggttcaagcgattctactgcctcagccccccgagtagatgggattacaggcatgcgccaccatacctggctaattttgtatttttagtagagatggggtttctccatgttggtcaggctggtctcgaactcccgacctcaggtgatccacccgtcttgtcctctcaaagtgctgggattacaggcgtgagccaccacacctgacctgttctttttttcttgtatatgtgttgtgtgtgttcaatcaacaacttttttttgaacaggacagaaaagtccttcaataaaatgaatttatgaatataacagttaagtatatgctatttttatccctcagatgttttaaatttctgtgtaacatagctgttatgggctaaagagcattatacaagtttaaaatattcttgcaaagcaaaaacactgtgattttggctttagtaaaagcagaaggttctttgaagacctgtaaatctacactttgctacttcctgaaagaaaagtgattttttatatcataatttgtttctccactccctcatcaactcttcattgaatatgttctaggtacctggtaaatctgctaagctttgggaaaaataagatacagcacctgttctcaaggaattaagagttcagtgtggtcctttggcatatgtataaataaatacatccctatgaaatgtgatatactacagtagtaatgtatacaagtggtgtggaagcagcaatcacaaataaattatttcagaaccaaatgatctggaaattcaagacttttggctactttgcttaccagcatcagcaatcaagtcctgtatatatgagcttgag

SEQ ID NO: 2033 - DNA, 1888 bp, Homo sapiens
attagacagcacactgctgactgttttcagttgtttctgtaacagcagaaagtgcactcactaggagtagtcagaattcaaaatgctcaagagaaagccatccaatgtttcagagaaggagaaacatcaaaaaccaaagcgaagcagcagttttgggaatttcgatcgttttcggaataattctttatcaaaaccagatgattcaactgaggcacatgaaggagatcccacaaatggaagtggagaacaaagtaaaacttcaaataatggaggcggtttgggtaaaaaaatgagagctatttcatggacaatgaagaaaaaagtgggtaaaaagtacatcaaagccctttctgaggaaaaggatgaggaagatggagagaatgcccacccatatagaaacagtgaccctgtgattgggacccacacagagaaggtgtccctcaaagccagtgactccatggatagtctctacagtggacagagctcatcaagtggcataacaagctgttcagatggtacaagtaaccgggacagctttcgactggatgacgatggcccctattcaggaccattctgtggccgtgccagagtgcatacggatttcacgccaagtccctatgacactgactccctcaaaatcaagaaaggagacatcatagacattatttgcaaaacaccaatggggatgtggacaggaatgttgaacaataaagtgggaaacttcaaattcatttatgtggatgtcatctcagaagaggaagcagcccccaagaaaataaaggcaaaccgaaggagtaacagcaaaaaatccaagactctgcaggagttcctagagaggattcatctgcaggaatacacctcaacacttttgctcaatggttatgagactctagaagatttaaaagatataaaagagagtcacctcattgaattaaatattgaaaacccagatgacagaagaaggttactatcagctgctgaaaacttccttgaagaagaaattattcaagagcaagaaaatgaacctgagcccctatccttgagctcagacatctccttaaataagtcacagttagatgactgcccaagggactctggttgctatatctcatcaggaaattcagataatggcaaagaggatctggagtctgaaaatctgtctgacatggtacataagattattatcacagagccaagtgactgaacacgcattcccaactatatatctacagatgcattccattttaactcttcttgagctaaaacgtcaaataggagaggaagataagataaatatttgtaaataaaacctaaagtttaaatgttttaatctgaataattgtacataaaattttgtatctctaacattccaaattactgtcaataaaatatatatttattattttaaatgctatgtgttaatatttcacttgcttgtattagaaaggcaaaatgtaagactttggtatgtgtgacatatgctttatttggctttattttacaagtacagtatctgcaaaaaacaaagtaaccttttttcatacctgccagttttgaatttatatatgttattgaacaaatagtaatagaggattcgctgttgaaacaagttgtccaagcaatgttatattcatttttatacttattgggaaagtgtgagttaatattggacacattttatcctgatccacagtggagttttagtaattatattttgttgatttcttcattttgttttctggtataaaagtagagataatgtgtagtcacttctgatttagtgaaaccaattgtaataattgtggaaatgttttgtctttaagtgtaaatattttaaaatttgacataccctaatgttaataataaaaagaactatttgcatattgca

SEQ ID NO: 2034 - protein, 377 aa, Homo sapiens
SEFKMLKRKPSNVSEKEKHQKPKRSSSFGNFDRFRNNSLSKPDDSTEAHEGDPTNGSGEQSKTSNNGGGLGKKMRAISWTMKKKVGKKYIKALSEEKDEEDGENAHPYRNSDPVIGTHTEKVSLKASDSMDSLYSGQSSSSGITSCSDGTSNRDSFRLDDDGPYSGPFCGRARVHTDFTPSPYDTDSLKIKKGDIIDIICKTPMGMWTGMLNNKVGNFKFIYVDVISEEEAAPKKIKANRRSNSKKSKTLQEFLERIHLQEYTSTLLLNGYETLEDLKDIKESHLIELNIENPDDRRRLLSAAENFLEEEIIQEQENEPEPLSLSSDISLNKSQLDDCPRDSGCYISSGNSDNGKEDLESENLSDMVHKIIITEPSD

SEQ ID NO: 2035 - DNA, 30654 bp, Mus musculus
  misc_feature (1)...(30654): n = A,T,C or G
gtcatccccacctttgccccactcattcttcccagagtgctatcccaagacgagggttctaaggaccaacttccaaagcaggtagactccactttatctcccacctgactctgcttcctggtgaggcattgcctaagcactcctgaccccatctcacctcataaccagaacaccattattccttccatgcctgcacagaagaccctgcttggcaagaatcctgccatctccttacccactctgttcctgttaggaagggttgagagaaagccagtatgtctctatgaagacacgtgcataggaaacttacacagaatagatcccaggctgcctgggtcactatgggctgacgttaataaacaatgcatgttttctggatgaagaaatggtttactgaatgaaggaatcattttatccagtcactcactctgttcactgtagactcagatatctgacattaatcaattacttctctccagccaaagaaagggagactgtgtgctcccacaaaaaacacttggcccctctgcatttaagctacgctctccaagaccttttcctcctgtcatttcagctgcccactccttatggccacaccctgtgcctcatcagcagctgaaactgctccacctctgaaatcttgaattccagtatcccactctctcaccacaacctactgctcctcccaccctctccttgcctgactgcacctccccttatcctgcatacacagtctgcattctgtcatcttctgcttgtctcttccagctgggattgagccatgacccagtaccctcagtatgtggattccatgcatccaccgtctctgctagtcgccctgccttggttcagtaagggcctcttatttagagttctcctcctccatctcagtcatgatgaaatgggtcacactgctgggccaactggccctgctattggcacaggacctttctctggctgtccctttcctttggctacttggccattcatgcattcagcaaatacatgttgcacacttgctttgggtcagtactgaaactgtgggaacacagttattggcaacacaggccctgatcttggcactgacctcttattgggagaggcagtaaatagatgcataatcacgatcaaggggcagaattaagggatgtggtcagtggttatcatatacataagaaaaaggttgaaaagaactttaaaaaggagagaagagcttacagtttcagaaatttagtctatcatagtgcagaaggcatgggggcatgcctgggtggtagcgggggggtctgtctgtggtggaggcttatttctttttacaattatttttattttattttttaatgtgcctgggtgctttgcctacattgatatcagtaaagcacatgcatgcagtgcctgagaagaccagaagagggtagtgtatcccctgggactggagtcacaaatggttgtgggccatcatatggatgctggcaaacaaacgtggtcctctgcaagggctacaagtgctcttaaccgcccagccatctctccaggccccaaggtttctttctcgttgaggaccaggaagcctaatgagctgactagcaccaggaacagatcccaatcagagcaaggacaactttcaaagcccaggctgcagtgacccacacctgccagccagtctacacacccttaaggctgcaaaactaataccacaagctagggactatggtcaaaccacaagcctatcaggggggacattttggatttgaacataacaatttctagaattcatgaccttcttgcccccatttactaaatactgggattacaggcatgagtcaccaggccccaggcttgatgtcatgacaacagagcagtcgtctcctgcaactggaggtttggggtttagtttatttattcatttgtttttttttttttttttgacttttcaagacagggtttctcagggtagctctggctgtcctggtccttgctctgtagaacacgcttggaactaagagatctgcctgcctcctgaggagtaggattgaaggcttgtaccaccaccacctggatgggtatatattttttaactggcttatgtttttatgagcacgagtctcctgcctacatgcacatatgcatattgcatgcctggtgcccaacgaggccaaaagaagggtgtggaaatcttggattggagttaaggataattagaagcctctgctgagtgctgagaacctaacctgggtcctttactagagcagcaaggactattaactactaagccatctctcttctccagacctgttttgtttgagacagggtctaaggtagaccaggctggcctttaaagtgttacacagcaggtgatgaccttgaattcctaatcttcttgcctccgtttcctacgtgctgatattatagacatcagctatcatgtcaggccaaagccctggacttgatccctagcattgcaacaaacaacagtggcttcctagaactaaaaacatttaatttaatgttattgctgttgtgtatatgtaatgtgttcatgttttatgtgtgtgaggtaggccatacatgacattgtcatgtggaagttagagggcaaatctgtggggtcagtccattttctacttttgtgagggttctagggattaaatccggtggtgatcctgacagcaatacctatacccactgagccatctcactggcccagaaattttttattttaaacaaccagatatttatgtacgttgtttggtcctactttcctgatgactactcatgtagccgacatccacatgcttttattggtcataaaaatactatcatatatttttattagattcctttatctttattgagtaccaggagttctgtttggttttgattagaagttatatttgtttcctttacaatcttggagattgagcccaagatctcatatactaggcaagtgttctaccaacaattacagccatctttattttatatttttcagttttgaggcagtatctccttaagttacctaggctggccttgaactatatatttgagagtggcttcaaacatgaaattttcttgctccagcttccagtttcctgagttgttggggttatgggggtggggtgtctgtggtcaaggctggcttttgtttttttttttttaaattaaaatttaaaaaaatttattccccccacaggcccacctacacacacacacacacccacacacacacccacacacccacacacacacacacacacacacacacacacacacaccttgagacaggatttctctgtgtatccctggctgttctagaactcactctgtagacgaggctggcctcaaactcagagatctgcctggctctgtctcctgagcgttgggattaaaggtatgtattaccatacccagctaatttattttaaattttttatgtttgtgtgtctgtgtagaagaaatgtgtgcccaagttgcccttagaggccagaagaggccatgggatcccctggagctggagttccagttgtgagctgccacatgtagttgttgggaacagaagagcagcagaattgtttctccagccttccctggtgacctaaattagccatggactcagaatcttctttctttagcctccccatggctgggattacatgggtataccaccatgcctggctaagggctcttcacagaccccagacactagtctgttaaatgtgtattttgtaaatatttttcccagtctaaatacattttcccaatttatcttcatttatttacatatgtgtgtatctgtgtgaatgcatatgtatctatttgtgcaggtgggcttgtcttgaggacacaggtatcaggagaaggcactggatcccttggaaccacagttacaggtctttacaggatacaaggatgaggttcattgtgccggtgctgagatagaaactctggtcctcatgggtgtgttgttagcgttcttaactgctgagccatctctcgagcctcagtcttgatatatcttcttcattttcttaaacaagtcttttaatgaccactggctatcatctctcatttcagcaacagtgatgggaaagtgctaagccatgtgtagtaggcccttgttatcatctctgcctgactaaatcatctacaaaaggagctgtgttcttgaacttctgtgtattttgtcttttgtcataacctgttcactatgattagtctggttaagttaagcattcacagtgctgtggttaccaggtctgaccaccagagttaaatggtgagcatgcaccagtgttgtgcacattacactgctaaattgccaaccgctgtttacatttattgaacgctcacccggggagcaaaacttgtctcctccaaaactcggtgtcctgggtcaggctgatgatcacctgactctgtaagggggtagaagaggagaaaaatacgcgcctaagagaatttaaagcatcttatcaggctggaaagaggattcatccatgaagagtacaaactgctgttgcagagaacctgggattgggcccaagcacccacattgggcagcttacaactgcctgtaactccagtcttacaagatccaacacctctacccttcactaacattcacatacctaaatacagacacaaccataactaaaaaataatacaatagtttaaggaatttgtatagctgagaacagctacaaggtaaagtatttctaacagatgttactgttgtttagcttatctatagtgggaaaaggggcccagagctcacccatggtgagttcagtggagaactccagctgactcccttacccttcttagttggcttctgctggatgtttataagtgcacaaacatggtggggatcttgacaatgtgacacattgttctcccaactgggccattccagtcatctcggtgtttttaacacctgatttgatgtcttcttgtttatctgcttttctgtcgggctacctgctatttattgttttttacttttgcttactttatatttaataagctcactcattcaaaccccaaagtatggctattagaggccatctccagggctgtgcagaacaggcagtgacccgctgtgcaagctttgagggaatgaattcaaacatggtcacaatgtcaggcatcaattttatcataaggacaggggtcaggattggggaaagcaaatgcagtcttgtggccagattgtagttcacagatgaaattagttagcttactcttgttctcagggaatatctgacactctttagccaaaggattcttttaaatacatattaaagcattttaagataaagaaatgggaagacagatatgtggggtcagaggatactctgttggactcagtttattcctcccacctggggatcaaacttagggttgctaggattagcagcaagcacacttaccctatgagctacttctacagccctctgtcaaaggattctacaattaaacagctcgagcctggtgtggctgcacatgcttttaatcgcagtattcagaaatctgaggcagatggatgtccgtgtccaaggccagcctggtctgagtggcagacactctgaaatcagtgatttgcggcattttactctcacaacagccagctgcagtatgaaccagaggcagggggctaactctcactatgcagcagcacatgttagagctagcagtgaagcccaagcagtctagttcagaagtctgtgttccacagcccctcatcaaagttcactgccccccgccccgcccccgcccacggggaagcctgggtgccttgttagacaagatgtcaaaagcactggagcagcactctctgagtccagctactccctcagcggctgtcggctgggcaaggtaggtcagacctttggggttgaatgcgcagagactttgctcatgttgaagcaaagcctgtgttctcttctgtgcagttgctgactatcaattgtgctgttcctgttggagagacaagtggatgtgtttgaaataaaaaccatctttgtggagctatgtggtatcaacaagggctaaagcgtatgaaacgctgaaggcctttgggtcaggataacttctcccccttctttctatttgtgtgtgctgggatcacacccacagccttgagcttgcaggcaagtactgacccactgaactaaattcctagcaaagagtgctatgttctgtatgcatctcttccctcagatttggatgttgaaatcctcaaggggatggttagaggaaggggaatggtattagaggaaggggtctggggagtggggtggttgccagtcagctttctgaagctgtgactaaacacctaagaaagcaacttgaaaagaggacaggtttacactggttctcattctcagaggtgtgggtcccatggcttcgaggctccatggtggcaggaacatgtagcccaggaggggatatgtgcctcaagctgtcaggaagagtgaggtttttaaaaaaaaaaaaaaggagaaaaagaaggtggaaaaagagggggagagaacttccataggcatgcccccagtgaactactcctccaagctggcccctacttaaaattttaaaaaattctttacattatttactttgcatgggggtgggtgcacatgtgtttggaggccacagaacaacttgccagaattagctctctccttcactatatgggtgctggtaatcaatattagatcaccaggttgggtacaagggctattacttgttgagcccaggccccaactcttaagagcctattcaggtatctgttgatcaagttggagctgttataatccaatcacttctcaatattaccatcagctggggatcagtgttcaacacatgaacaattttagggagtataacagttcatattcaaactatagtgggggatgatagggttaagggtggagttcttataaatatgatttgtgggtttgttgttgttttgtttgtttttaagacagggtttctctgagtagccctggctgtcctggaactcactatgtagaccaggctggcctcaaactcatagagacccgactgccactgcctcccaaatgctagaattaaaggcgtgtgccaacactgctagtctgtaactggagttcttataaagtaggttttaggaagctcaaggtcttttctaccatgtgtctttcttagcagtgagaaaatgcccatgaaggaagtcagtcctgaccagagctgaggataccctgaactttgacttacttgcctccagaattctgagaattttctgttgtttataagctacccagtctgaggtgttttgttacagcagccagagtgaccaatggtttcatcttatcaacaagtatttactgagagggtcctacacacctgtattggctcaggcaggggccataccgatgtcactgactgaggatgagagaggtgctcagagaactacaatccttgatgataatcataggtttgcttcaaagtacccaataatccaaggatgctgaggtccctagctgcctagtgaggctgggcaacatatagaggctctaatatattatttaatatttagtgacaaatacataaaagtagacccatcctaggatgaataaagacttgtaggttctttaaaaaggacaatttttggagttgggagaaatggctcaatggttaagagcatttactgctcttccagaggactcaactttggtccccagcaccctgacaaccacctgtaacttcagctccatgggatccaatgtctttagatgtaggtacctgcacttctgtgcaaatacacactcacacacacactttaaaataataaaaacaaagtaaaatgagtcctattaacttcaaatggactgccatcttaagggaactatagtccccatagaaaaaagccaactttagaaacaacagccttacatttagttcaatactatcaaagttgcaggatattttaaataattgcaaaccagtcagagaaaaaaacccaaatctgttattaatgacattcatacagaacagaaaaatgagcaatatatttaacaggtgagtcttggtaaacaggtagaacttgggtataagggcatgggaggtattctgaagtccagcacagcaaaccttcagatatgacaccaaatgctcaaacatctaggtgctacaggagacagtactgagctgaaacaaaatggcctagtatctttaaccacattagaaacagaacacatcaacaaactgtccaatgttcttgcttcgatttttcttttaaaatgtttatgtatttatttatttgtctatagacatgaacatgccactgagggtatatggaggctggagaataattggcagaagtctgttctctacttctgtcatgtgggttccaaggactcaggtcatcaagcatggtggcaagcacctttacctactgagccttctgcccagggtggccttgaattcactatataggtattatcttcaacacctcatccttttgccttctctgaagtgctgagactggatgcacacaccaccatgcccagcctttttctttcttcccttttttaatactacagagatgccaaggtttagatcttcaatatgggaaccagaggcagaaacgggctactctacagatttagccaaggtgactatgaagacagcattgagctaataaaaagtgcatggtggaacagtgaattaaggaagctggttttagaagtaggcagtcatggtgctggcaggcaattgtggtgataaatagattacaactaaggtctggaggccagagaattttctagttttgaagacacaaaataacttttgattgagttgagatattacacgctaagttttgggattctaacctctttatacatttatttatttatttatttatttatttttgttgagactgtaatccagaccttggtaattctccagtctcagtcttttagacactagaattttaggtgggggtcactgtgcctcgcttgggaattggcaattcctcagtctaatttggaatacgagcacaagaaggtacgtactgtctcaatcacctaagtcaaaaattcttgagcacatctatgggtgatcccagaggaaagatcagtcgtcccagaaaggagtgaagcagctgtttgaactttaaggggctgacagggacctgcaactcagcacaaggtggtctgagtggtgtctacatggcaccatcttaagacctgggagtccggggactgtgccaacactacttgatagagaaacagcacagaaaagttctgtagcagatcgctctgctcagaaagaaaaggcttccacgagagtacaagcctttgcaaagccagcaggaactagtgagccatggcccaggggcaaatgaagatgaaagcacccgaccgagagggcttgagtggaccctgactatgagagcgtaagtgcctatcaaagagtcgactggagccagggtttgatagtggtttcacatgactttggagaatttcacatgactttggagaaaacattacttaaccattctctctttcccagactcgtcttttcataatgtgtttggaagaggatatagagaaagactggcgagggtcctctactgttagaaagtcatcccaaggcctctgatgtggacaacagaacttcctaaaaatggtaagtggttataactgtcacattctagtctcaaatgatatcaggttcaaactcacttccccatctcatgctttctcgtacgatttttcttttcattttcgctttttccaaccccaaagcacatctctccggacccgctcttgccgcctctagtgcctccgccctggggcagcctagtgagcgcgcacttccggagccaggaagtgcgtcatcatctcgcgccagttcccgcacattgtgccggttcgcctcgggtttggatgctggggtattcgggtgggtcggcgttctgtgactgcgtgccgggctccggctgctccgcgctgcgatgcaggtctccagcctcaacgaagtgaagatttacagcctcagctgcggcaagtctcttcccgaggtgagttctcgccccctcgccatcgccctgggagcgtgtatctctaacttaccatcggctgaccgtggtggctggttttatgtcaacttgacacaatctagagttaactggaaggagggaatctcaattgagaaaatgccccccataagatctagctgtaggacactttcttaatgattgatggggaagagctcagcccttggtggtgccattcctgggctatggctctgggttctataagaaagcaggcccagcaagccagtaaacagtactgctcccatggcttttgcataagcacctgcctccaggttcttgccctgtttgagtttctgttttgagtttcttcagtgatggaccgtgatgtagaagtgtggctgaaataaactttcctccccaagatgcgtttggtcatggtattttatcacactataaaaaccctaagacaagaccgttgttttgcctgcattgggttcacgtgtaagaacgtgctgtttagaaactactctcacgtgctttaattaaaaaccttattgcctgaaaacagtcagagcaatacagtcacagactgcagagaggaggacgactgtggctcacccttagtctgtttaaagtctcatcctgttccaaatgcagactgccttggcgtatgcttagggtctagggaggtgagttcacatgtttagagattattttgccataactagtaagaatagtacattgacttttcccttttagaaaggattttttttctattgggggcatttaacctcaaatttattgacgttttaagctggacaagtcttgttgctagtgttgtttgccagcatccctggtccatacctacaagatccaattgtgatgacagactaaaatgtaaagacttgccataagccatctgggaagcaaaattgtcccggtagagacccagccactcagtgtcacgataactgactagtgctttggttgctgttcattcaactgttgcctgtagaagaaaatcagcttccagtgaatgtgctggtaaaaaccacttcttatccagggtcgtctattaggccagtcataggtctgtttctattctttgtaagaaatacatttggctggcaaagagacacgtttataatcccagtgcttagggcgctgagacaggacatttgtgagcttgtgttcagcctgggcgacagagcttacattgtgtgactctatcttaacacaggaatatgcacacacattgggtgcactcactccatatagaaattaaaacccatcatttcaagagtttgcattatcttagcttagatggattaattttatgcttttataattctttgtaaaacagatgctttacaattgtttagtatatgtaaatatattttttagaaagtccagaatatgagggctggagagatggctcagcacttagattactgactactcttccagaggtcctgagttcaattcctagcaaacacatggtggctcgcaacggtctctgatatgatctgatgcttctggtgtgtctgaagacaacaacaatgtactcacatatataaaataaattagtcttaaaaaaaagctgggaagtggttaagagcactttctcttcttccagagatcctgagttcaattcccagcaaccacatggtgggtggaaatactttattctgggatctgatgccctcttctggtatgcaggcatacatgcagacagagcacttacatacattaaaaaaaaaaaaaaaagtgaaaatccagaatatatgttatcatggagttaagattatagaatagtcctacttttcattttattatttcctgtaagcatacattttctcaaatgaacattattttgcatgtggaagataatttaggtgtgttttaaagtgcactgtctgctttctcgtagtggctttctgacaggaagaagagagcactgcagaagaagaatgtcggtgagtatgcagggtgctccagcttgtcatctgcctgtgggcagtgtcctcagttctctggctctcaggcatgggctgtgggaaataagctttttgccttctgtctttggcattgttggccactgttctcctggtggtgtgatgtcccccttccggttaacaaggtagcctctccccctcttatggatggcagcgaggctcctgggttagagacacaaacttcaggatgcacgacatggcaagatggcaggaatttcagcatgtttatcccagttgccccttgagtcagcatggtttggatgaggcctgtacacagtgggtctacgtttcacagaggagcccagaggtgggaagcccactgttttggtagcaggcagaaaacaggcctgcccttctatgacctcctttgtcaaattcctcaattgccaacagccctgagacatggctcaggtaaaagtggtcagactcttgcaggactgccatactcagcaaagtggcccaaggaggactgtcgttcaaaacagttctgtaactgctttgttcctaatgtgtcagaagttttatctgttagttgaatctctgtgttttgcaatagacagacagtaaaagttttctttataaacagaagaactttgtgtgtaaaatgtctggatgtaaacaatgagacccatttgtaactcacagtttattcccattaaacattttccagttcaggttgccacgaaaggaagcttaccttcctgaagatttcagattttagctgaatctctaaaaatggagagctaggagggtttcagcatgagattgagatcttttggcaagcttcttggaaaaaacgggctctatatagtactaaagtcgggtaagaagtgagatttttaacttggaggaaacatgctgcctggagcttacagactggggctttatctgctccccttccagggcattcacgtgtagcaaaatggattcaggttatttatgggaagaaactgttttctggcctgcgcaggactaataggtgtctagcaattcaacttgttcagtatttgatttttttgttccttgtgatgccagggattgcacccagggcctcaacatgctaagcatgctatttagcactatggcacatccacaggccttcctctaatcttaatatctgggttttatatgcaaggcataaatatgtcatagataagctgtgttcacagtagtgaccagtcagaattcttaccctggtagagaaaaatatagttttttgagagtaggtcttagtgctgtggtccacagaggctgcactaggtcttcctctagcctgggccctcttggccacagagaggcagagctagcaggcaagcatcaactctacgctaatttctttgataagcctaagattttggaggctatgcctagatatgtttagtggaaatgctgtattttgttgcagcagtgactgatgatgtgttagtgttcctccttgactgaggtctttaaactctttctgattatcattgtggacttttcagttaaagaacatgttctttctttttaaaacatgagaaaaaagtcagttttccattacggtagcagagtacctgaggtaactcaaaggaggaacgctttgttttgcctgtacaagttgttttgttgctttcaggcctgtggtgaggcagcacgtagtggtgggaactcatggtggaaggggctgttcactgtttagcatctaggaaacaagaggagatggagcaagtgaatatcctatagtctcctttgagggcgtgactccagtgactaagacctcacacccctcccccaaaagttttactacctcccagttaaaactgggcccaggagccagacctctggacacttgggtccctggggggtttcggatccaaactgttgcctggtaggagcgaagcagaaagctgggtgggctgctggggtcgttctcagggctgggagccgttggattgaatcctgctgcctgcagtagctgtgcctgtccggcatgccctgtgctccttctctgatgctcgtgtggaacaagtttccatctctcccccttccctcttggcagatgttcgtaggagaattgaacttattcaggacttcgaaatgcctactgtgtgtactactatcaaggtgtcaaaagatggacagtatattttagcaactggtaagcatttctgtggttccgatttatctgtgttcctaacaggaagtgctctagtaggaaaaggtcacccctttgtttacctcagagtttcattatataccttttcagacatacagaaatactcagaaagagtttaatgagcactcattttatctgtgacctaaattctgcactggaatagtttannnnnnnnnnnnnnnnnnnntgcactgaatagtttactgtgtttatttatcaatctatatctttttaaaatgagttttcggagtaggtcacagaataacagctttttcattttatttttaacttttggcctcattatgtatcctagactggcctcacagtcttcctgcctccacttccaggtgctgagattgcaggcatgtgcatccattccaggttttgcccattccattttaatggcttcatgtatacccagccaatccctttgtgctgtattgatggctggctcagtaccaatgctgtccatatctgtaaccctgtgggttggtttttttttttaggatttattatttttatttgttgtttttattttatgtatagcagtagcatgtaagtttaatgtgtgtatgcctaatgcccagaaagccaaaagagctttggatcccaggaactggacttacatacagttgtaggcatcatgtgggccctggtcctttggaagagcagccagtctcttaacagtgataccttcagcctctgtttttattttgagaaactgggaaagagagttgagaagacctgagatgtttggacatagttactgagagctggaaggaacttagacctttaattcaggtcttctagatccagagatactgaaagatgggcccagtgctctttggggtaggtcaagtggtagggttttgttactatttgatgtaaacaggctcacactatgcagctctggctgtcttagacctggctgtgtagaacaggttggcctcaaacgcacagagatgcccttgcctcccaagtgctgagattaaaaatgcatcaccagggtttggtccccagcactgaagagaaggaaaggagcacgtgtgaatctggcctgactctaaactgaatgtttccaaaagaagccaagaggctgcttagctctgtgaccggtcacagcttgcacatgccctggtctgattcctgtggatagtaaatgtccctgtcttgacgtttcaatctccaggaacaaattttatccaacttatttttagccacaagtcctagagcagtgacaaagatggaggcagtggcagaagccagagatgaaaggcctagctctaccaccctaagcagacagcagtggattcctaaatccacttctatctccaaggaaagggccagagtggaggtaaacaagaggaccctacacccaaccacactgtcccataacagtcactagctgtacagagatatttaaattaaaagcaattacaatcaaaacttcggttctgggactatcaatgttcattattgatgttcattattgatgaaaagtctctaagataaaagtaaagcctacctggtggtggtggtggcggcggcggcgcacgcctttaatcccagcacttgggaggcagaggcaggtaaatcactgagtttggggccagcctggtctattagagcgggttcctggacagccagggttacgtagagaaaccctgtcttgaaaaacaaacaaccaacaacaacaaagttatctttatttttcctcactgcaatgcaagcatggtacattatatggcatgcaaacattatagaagaacgtgacgtaagatgtgagcatccctaggcagttgctgtgtctacactttctctactcaccatctctatgcagctgcctttagcttcacagaattgggattatatgtactgtgttgcagtcttcgaactcacttctcttaccatttgggagctgctgaggtggctcagccagtaagggtgctggctgaggagcctgagttccatccctggactccacgtggtggacagagagaaccaactgcacggcacacattgggagtctgttattggtgctgcggctctgctcatctttgtgtgcaccatgtttcctggtgggggttaccaccgtttatttaagcaaggccctatcagtggagcctgtttgcttttaatctttggccgtgtgtgacacaaggtgcagtgacattcttcctgtagctgttatgcttgtggctgggtttctgtagtcctagtggtgtaaaatgaaatacagtttcaaggtgaatttctgtcacataccttacatgtattggacattatcagggaagttgactgacacaaatattaagcatccttttttgtcttgtcaagctgtttgattgtttctgtcttcttcgctggattactgtgactcttctaaggtattttaatttcattctctgtggttctttgatttgaggataattatcttacctcaggacagaaagagcacaaagcagttgtataaggtgtggctatgcaactttggttttgcatcatgctaattttttttataggaacatataagcctcgggtccggtgttatgacacatatcagttatccctgaagtttgaaaggtgcttggattctgaaggtaagaggccaaccctgagttcataaatagcttttcataattgtctattgtactgctctttaaaatgggagtgagtagtgtggtatgttttggttgctgtagattaagtagtttaatatgatgctgcacttaatagaccgcaacctgcactggccatgctctgggctgcgcacagggcttctctcaggggatctgccaggtgggctcttacctttaaggctggtctagagtaggcttccagcctcacaaaggtatggctatgggactatgggtctggaaggtagtgtctcccttcttgctgggtctcagctggactccatttgctttataaggctgccagcattttttaaaaaaatcttatgtgtatgggtattttgcctgcatatctgtgcactatgcatgtgcctgataccatagtaggccagaagagggcatctgatccacatagactggagttacagatgtggtgcatgtgggtgctgggacttgctcgaacctgggtgttctggaacaaatgcttttaaccaccgagtcctatctccctccccgagagacctcttcttttaagaggttcatgtgattaaacaaatcttcccttggtcatactgtataatggaacctcagggagcatctactctcagcaggggcctggtgccctgtgaaggtcacagggggcattttgagaattctgtctaatacagacagcaaggtaaaatggcaagggtcagctattatcagttaaccagtgttttaggaacaatgggagagaagtaaatgggatacagcgctgtgtagaataaccagcataccttcctagtctcacccttgctgctagagaacatagaaactttgtatgctattaataacacatcttttacaatgtttttgtgtagaggtaaacttggtataggcgaagagttactgttgccttctttctttcttttttttttttttgtttgtttgtttgtttgagacaggatttctctttgcagtcatggcaggttcagaactcattatctagaccagactggccttagactcgcagaggtcttcctttctttctctcccaagtgctaggagtaaagtcctgcaccaccacaggaacacccagcctggggtcccattttaaaggctgctgtttagattatatttcaaaatcttaaaaactactaagaacatctcagcaaaactatggcaaaaatttttaggatcatcctaaatttactttagttctgttaaaaaaaaatctagatgtaagtaataactttccatttagtattagtggggatgttcttcttgttgcatggagaggtaggacaaacacagcaattatatataattattcaccagttaaaccagttaagagggctggggagatgtctcggtggttaagagcactgattgctcttccagtggtcctgagttcaattcccagtaaccacatgggtgcgcaaaaccatctgtctgatgccctcttctggtgtatctgaagagagcaatggtgaatacatttaaaacaaaaacaattagaatcctcacctgaagtttgtggttttgtttaaacactggttgataattgtggttttttttttttcctatttttcagttgtcacctttgagattttatcagatgactattcaaaggtatgttttatagcatatttactttttatttttatttatatgcacgtgtgtgtctttgacagtgaacgccgtgcatgtgcagttgcccttggaagccagagggggcatcagatcctcaggggattgtgagctgctgatctgatcccaggttctctgaaagaacagcaagtgctctttactgctgaactgtgtctctggctctgggacttatttttgtagtaaatatttttaagataattcccagcgataaaaaaaaaaatcactgtgtaataataggtaatatatcattttctgtcatttttcggccaagtacatgtatgatatacagtatctttaaaaaaagaaaaacaaaacactgggagtgaacttttgctcaccctaacgtcaagttggttgtcagtgtctccaggcctcacctttattctaagggattggtagcagtcaccctttgttaggtaccttatggtcgcgatctgtggttctgattactgatgttagcctaggcatgtttgccttcgtctccttatttgtacaagataaggaagccaacagtttgttcagttcttgtaactcatcgagagggtgtagtgtgctgtggtgcaggtctgagcacaactgaatagacttcttttcctaataccaccggtccatctttaacttttcgtggtcatcttcagtagttttcgattcttatggtagccctttctcaatttcaaatggaaatgatgggaagtacatggaacccttaagtattcaccagttaaaaggatttcaacaaacattttaatgtcacatgcatcctgaaacaaagttgaacttggtagctaacgtggcttcccttctggcttcagttcctccaactatgaggcacagattgtcttgttagctgtcgcagctgtttatctaggattttggtatggtgatttttataacttactttttctagtattgctagatatgcatttaaatactatgttagctttccatgcacacctctgtcaaatgtgcacatgtgcacacacatgtttatatttgtacagagtgagcagggggagagatgagagttcttcttgctcgggttgttttagtgatgacgaaagttaagcaaacaaaccttgatttttttttttttttttccttttcagattgtcttcttacataatgacagatatattgaatttcactcacaatcaggcttttactacaaaaccagaattcccaagttcggccgagacttctcttaccactatccatcctgtgacttgtactttgtaggtgcaaggtactgatcagattatttttgctttctcctttccacctctcacacaggtagctggcttctctttttagattgcctgtagactttatctacttaagtgtccttaatagagaaagtgatgtgtcattactgtgaaagggaatcaatcttagaaaaagagattaacactatatatatacatatacatatatatatacatatatataatagcctatgtgttgatatgtagttttttttttaaagaattatttgtttattttatatgagtacactatactcatatatgagggcatctggtcccattgcagatggttgtgagccaccatgtggttgctgggaattgaactcaggatctctggaagagcagtcagtgctcttaactgctgagccatctctccagcccgatatgtagtttctagtaggtggaattataatttttttgtcttattcagtatcaatgattaatttctctgtggaccattttgtcactaatggcatatgtagttgtagagttgggttaaaacctacttagagggctggggatgtggctcaatgctcaagttctttgtctgcaagcatgaggacctgagttacgatcctcagcatggcagtgcaggccagtgacaccactgctggactgtgtaaggagatcccttggagctggggttgcagatggttgtgagcggtctgagaggtgctgagaactgaacttgggttcctgtaagaatctcagatcttaaccaccaagatgagcatagtgtatgcctgtgagtgagagctgtcatgagcttctgaagtttatacttactcacccgaaatgcttatagttcaccagatcctttgtcccttgcagctctgaagtttatagattaaacttagaacaagggcggtacctgaatcctctccagacggacgccgcgtgagtactccagttctactgctgcacgaattttgcccaggagatggagccagaggctcgtgttgttatcaagtgacctagttgcattaaaccagcatcctgggccatcatttaaaagaacatcattaactgctcttaatcagaactgaaggtggtggtccgtttctttccttttcccaagaccactaccacctgaccctatgatttcttaaaagtttaagttcttatataaaaagacttgtaatttaatcctagcacaaaggaggcagaactgggtggatctcttgagttcaagaccaacctggtctacatagcaagtttcaggccagctggggctatagagagagaccaggccagccaggattttatacagagaccctgtcttaaaactgcaacaacaaaactacccaacttttaaaaactcagtttattatttttacttttattactaagttttcatcaatgatttgttttgtgttactctttttttgtgaattccttttttaagacagggtttgttaccttatagctctggctgtcctatataattcactatgtagactagcttagtcttgaatgccaagagatctgtctgagcttccctcccaggtgctgggcttaaagttacgcactgtcacactcaatttgtggaaatctttaaaattttattcttgattagtagacatttaaatttttagttgttttttgtttttttttcttttgctacatattctaagctaccttttcctttaaaaaagttttttggtaattttattgttctatacttactcttttgcatttattttgctttctgttccttttgagacagtgtttccatgtaccctgtgtggtctggcatttaatagagaccaagctggcctccaacttgtggcagtcctcctgtctccctctccacagagctgagatgacagacattgccaccatgctcagttatacttttattcaaaaagacattcttcaggagtgaccctaccgtctacctccttataatgacgagtagcagatgtgcagaagagtggacgcactccccatgccgagtgccgtgcagccctctatctgtatcagctaatagtgacagcagggtctggtagggcccgccctgtctccgttcacagagggcagctgcactggggtaggcggcttgcccagggccctgcagctaggcaggtgtggaagcgggactgctgcccatctgtacatgcagagcttactacctgtgccttatctctacgagagctttctgaaagaacatggagtggtaaaaatcctgagctggaaaaatgctttggttcttcccctggtttaaaatacttttgtttaaaaacttgtaatttccacccagttctgcctcctgagtgctgggattaaattacaagtcttcttatacaagaacttaaacttttaagaaatacattattatgtaatgaaaaattacctgctcatcagctgcttaatttcctgttcataacctctgttatttattacatatcctttatactctggactggagcattttgttctgtgatttaatcctcacagtaacccattgaggaaggtcaaaattcactccagcgagtaagaaaatgaggctttgtttgcacatccaggtcttgaggttgccatagtgatggcctgtgtccttaagaatgctgccttgccttggaaggaaatagaaggacctttcttctcatggtgggatagtatttcagaaggagggcttctcttgtctggcatctagcaggtagtgtccccctgggtattggggctctggtgactgtgagccatgccgttactcacccgtgcctcggtgcatttcctttgtggatgagcatctgcatatttctgtccacaggctttggatgcctacagacttagagcgttcattgagtgcctctctcttcccctgagctagatgctccctaatactttctcctgtgtttgtgttgctgtttagggagaacaatgtttgtgacataaatgcagtgcatggcttgttcgccacaggaacaatagaggttagtgcgtgttcacactgaaacaaatgtgtttcatttgttgacagtttcagtttgtgtgcattccacacttgccactgtgcttatatagagataagaagacaacttactgtagttggttccgttcttctgtgtgagtcattgaactcaggttgtcaggcttggcagcaagtccccttacccactgaactgtttttcatttcaaaaaagattttctggggtctggagagatgactcagcagttacaagtgtactgttgctcttatagagcacctgaatttggtgtccaccacccaggtagagcagctcacaacagcctatgacttgagctctggggatctgagatcatcttgccctttgggcacatgcacccacagactcatacctatatagagacatacaaatatatccaattaaaaatagagacctgcctaacattgtgggacctaggtttggtccctagtggtgtctaaattcgtgagacaatcagatagtcagtcaaaccaattaattaatcaatctttagcttttaatgtatttaagaaaattacacctttagacatgttgaaaacagttcagtgatagcgtcccacacattcctttttaaaataaacatgtcattttctaagaggttttctaagccatttgaaagtaaattatgaacattaggacacttcatgcctaaatatttgaaatacaatttttaaaaacaaggactcaagctaaggatggtagaccataccccaactcttggtagtagatattagagaattagaagctgacggctagccttgtctatacagtgagtgcaagctgatcttggctataaaagtctttgtctcaaaaagccaaaaaataaggtaggcgtggtgaagcacgcctttaatcccaatttgggaggcagaggcaggcggatctcttgagttggaggccagcctgctgtacagaattgagttccaggatagccagggccacacagagaaaccctgtctacaaacaaacaacctcccaaagctaaaaaagtaaaaagtaatacagattaaagaaaagacctatccaatgatcttaactactccggagactaacggaggaggatcacttgagccctggaagtcaacggtagcctggatgacagtgaggttcttattcaaacaaagccataaagacctttttcataaaatataaatgtcttcttcccgtggagccaactcaagggtcatgtgtctagttgggacttcttcatttttcttaattatgaagtaaatcaccttgtggtgaaatacccgacactgcctgccggggttacaggttaaaagctgagctttgattctgtatgctggtaaatgttcaaaagttttctagttacacttttacttaaaatgtttttttcctctgttcagggtcgagtggaatgctgggatccaagagtaagaaaaagggttggcgtgttagactgtgcattaaatagtgtcacagcagattcagagtaagtagcaatcaatttgcagtataagtgtcagtcaaccttctgatttaagtcagcgtgtcagtgtgaaattaattgccaaaggatgaactcttttctgactcacatctgagactggtgtcgggcattgttgtcctataaagctgtgggtaagccagggagattccttctctccagtacttctcagagcagcgtgggattttagttttcattcccccaggattggtgactgggcaggcgtgtgctttgaatgctatgttgaaggaagcaaagggtgacgttttctttttttttcttgttcttattggtctacacttaaacatttagagagtaatacatacttggagaggaaaaacatgtgacacaggtagcagcttgagtcaagtaagaacgagtctttgtcatccactcaccagcatgggctggcacaggttggcacccctgcccaggtgctggctgtaggcagaccaccctcaggcaggcctttgctccaggcttatctgttcagaaaagcctttctctgggcactgcttctccagcacatcccgtgtacttcagggagagtttatatacttcatgttggagggtaaagcgtctgatggtaacaggctgcaatgacactaaggaccctaaaatttagtgcatgatttcctttagggtaggaactcataactcctttgaaaagatgtttacatggaccatctttgattaaaaataataaagaatggctcagctgctgcagctcagtaggagagtgcctgtggagtatgcaaggctgcagggtcaaccttcactattacaggagcagcaagccagtgtataacgaactaatgatacctctttctaatacataaatcttactctgtattaagaagtaaacttgcgtgtttgttttaaactgctacatttaaagtgacaatagagacattcatttttcttgattgctttggggtttattttaaaatgataatcaacttcactaatcatggcatggtgtagaggatattaagaaactaagctaggaagttcacttccacatagaataaactaatgcaaaaaatgcatattaaaggttttttgtttttgtataaggtgtgcgcctgtgcatgggtgcagatgcctaaaaaggccagagggggccactgcatcccctagaagcagagcttgagttacaggcagttgtgagcagcttgtgtgggtgctgggaacctaattctgctcccctcagagcagtttgtgctttccctcagagccagctcttcagttgccacattgttttaacccatcagtgttaaaaaagaaatcaggaaatatactaagaacaaaatactaaagttactcattctaattttctctcactcttaagcattgatttgtctttgaattatgtcaagatgtgtgctctgagttccgtgtgcccttagcatcacaacctgactttgtttctctttgttgttgttgtttcttgtttttctcttatgaaatagtctcactccagcactgcctggcatagaactctgtatacactgtgctggcctcaaatcacagagatccacctacctctgcctcctgatgcttggatcaaagttgtgtgcctaatgacttgagttcagtctctggatcccccagaggtggaaagaaagaaccagtttcacagagttgtcctctgacctctgggtacatccctgcgtgtgttcgcccaatcctccttttgtttttaagatttatttatttatttatttaatgaatgtatgggagtacactgtagctgtcttcagccacaccagaagagggcatctgatcccattacaaatggttgtgagccaccatgtggttgctgggaattgaactcagtacctctggaagagcagtctgtgctcttaactgctgaaacatctctccagcccgctttgttttgttttaaagcaaacagatgtgtagtagtcactgataatacatctcaaggctatttccagcataagtgcagtgactataggagatgggatactacacagtattaaggacaaggatggaaaaaggccatcttcactttggtctttagaagtaatgggagtactgtttttttctgtttatgattttttgagacagtgtttctgtgtatccctggctgtccttgaactcactgtgtagaccagactggccttgagctgggagattgccctcttctgtctgtgctgggattaaaagtgtgctcctcatttgtatatggttgaaatattggaatttggggtttttttttttaatgaaaattgattcacattttgtactgatttttttgttgttgttgttgttctttagaggtaaggaattttcagctgttgtgataaaatattttgaaaataattatatttagtataacaaaagacactaagcagtatccgaaacagaaagaatagcagagacccacctgctgtgtagcagaatttggccaaccagagcctctgggaacatatccaatgtttgtagttcagtggttatttcccaagcatctagaactgagtttttgggttcctgctaaattgttttacagaaaacctaatataaatataagcatctaccaccttattgagtggccactgtctccttgtcctcagctgaggctcctccccagcatgtcctcaccattctttccttttcctcctcctccttttcttcttcttcctcttcttcctcctcctctccctcttcctcctttcttttcagtttattacatttgtttgattgactgattttgcacgggcagggcacacccatgcatgtagaggtcagagcacagctttgaagtgagtcttctttccttctccctgtgggtccagttgtcaggcttgggagcaggtgccccatggttggcttcactgagccctctgtctagctactgttagttcttgagctaggctctcccctgtccatgtgggctgttaactcctgggtctgagggagtctcctgggtatctggtatattgtagacacacagacacctctcccaatttattgttattagaaagaacagaggtagcagttaactagagctacctgactgcttaacaggtagtgattttttttctctttttatattaaaacatacgtgtcaggctgccttcagacttcctgcgtggctgagaatggccttgcactcctaatgcttttcctcccaaatgctgggactgattacaccaccctatccctaccttagtactggatatttatttaccagaggctttggtgagttctttatgaacagaaagtgacgtcttgttaggtactttaattttatgtgttttatgaaagaaaactctccaccaatgacatactcattgttcagcttttgagaattttgtttcagaagtatgttagtgtagggaagggtatataaatacccatttttagatatatacctttcagtgagaaagaaaaacatacagttgtcatagagttttattaaattcttataacatttgttttgttttgttttgtttttgtttttcgagtcagggtttctctgtgtagccctggctgtcctggaactcactctgtagaccaggctggcctcgaactcagaaatccgcctgcctctgcctcccaagtgctgggattaaaggtgtgtgccaccacgcccggctcttataacatttttataaaaggacaatgaccatgaccatatgtgtttattgtcatcagaagaacatccagaagcataagaaaatgttaaagattgctggtttttcttctgctgattttttcaagtgatcttattgtattgtattttttaaagatttatttatttttaattacgtatgtctgtttgtgtctgcacataagtacagtacccatgaaacccagaagagcgggttgggtcctcgggaactagagttatggatgggttcttggaatcaaaccctggtcctctaaagagcagccagtgtttttaacctctgagccatctccctagcccctgtatttttctttttaatttagctttatgcttttcctacaaaccttgtagcttgtcacttgtgttatttagtaagtttagtaattttagtaaagctagaagtactggatagagcaggctgtctttcttttccatgattgactgtctgcctgagaaagtcagcagacttgcctggaagccagggagaattaataggagagttacaggagctggttaggaaatgaatgtgcagaagtcagtgaatttggtatcttagcaattccccagaaggaggaggaggaggtggcagaaaagttctcataacataaactacaattattgaaggagtcattaacctgtctgaagaaagtgataaaattgccttatgaaataagcctgggaggagtaggaagataattctgtatgaacaggtattctgaagttcattttgaagagtaggtgatggagtctgaggagcagcagcctctccagccgctgctcagtgcagctccaggctaaggctgtaggtggcaggagaggcttgctagtgctccgggcatggtctggccttgaagggctgggtgcagagctggtttctacttgttgttgcgggacatgatctcactgtgtagtgtacctcagcctcctgagtgcagggattgcaggcaggcatcagcacagccagctctggtctacttctgacctaatctcttttttctaccttaatgttttggcgctcgtgtctgtagctggtgcatgagaagcacgtatagaattgtagccgtaccttttgttcttcagtaccatcgagatttaggtcttaggcttttattttagatgaatgaggttgatctattttatttttaaaacgatttgaaattttgaatatgtgtgtgtgcccatgagttcaggtgcctgcagagagcaaaggtgtcagatctcctgagctggagttataggtagttgtgagccacctgacttggatgctggctggaattcaaatttgagttcgttgcagaagcagtgcatgttgttaacaactgagctctcgctcctgccttggtgaagttggttttacatcagaagtaagcatacccacccatatcccaagataaattgtttctctgagaatgatagggatgtttgagggctgggaagatggctcattcaataaagtgctagctgtgaaagacatgacttagtttagatccccagcatccatataaaccagtcactaatctcagatctggagagatggagacaggaaggtccctgggagtccctgaccagcaaactccagaatcactgaacattctattccaaagcacacatggatcgcagatatctgatgttgacccctggtgcccctgcacacacacggacacacacacacacacacacactgagggagagagagagagagagagaaagatatcctggagaagtttctgaaaacagtgttctattatctgaatagaatggaagatgaaggtgggttatgggattacatttgtgtgggaaatgtcttttttattatgaaagtttggatagagttataaacaaatagctggtaacatgattttccttgttagatttgaagtgaggacaaacacttgcttttcaggataaacagcttacccaccatctctgcattgaagtttaatggagccttgagcatggcagttggaacatccacagggcaggtaaatgtcacatgtgagcatgtgagccagtattttggatgtgtattggaaggcacttggatagtgagtgaggccggagtggagaggtgctccagactactaggtccttttagcacctcagaagatcggtctagtcctttgatgttagagttgaatcgaggtagtcttcagacattcctgataggggtttggaacagtattttttagagtgtgtggcccaaatttgggattctaacagctttctactcttggagagtcacagtggatttaagtacatattttgaagaccctgggaatcctgcaagtaagaattgtgttcactaaatatttccaagatgtgtgcatgcaaagagccattttttttctttttcttttgagacggtcttgacatacaatgctagctggcctagaattctgtgtagaagaggctggccttgaactcacagagatctgcctgtctctgcctcccaaaggcatgtgccacaatgcttactcaaggtcacttgttgcagcagcacctgctgtgtcctaggccacagatttgctaattaattagcaagcaaaacattcttatgaatatctgtccctttcttagtatagatcagtaattatcaaattagtggatctaaaaactactcccagggttaaagtcataaaacttccaagagctgactttagtgttaggctctgactaagtatgtttgtcatgttcatagaaggttatgaaataggtggcagtcattattccaacttttttgttttttgtttttcttcatgtgtatgtctgtgtatgaggaagggaggggtctcttataccccatga

SEQ ID NO: 2036 - DNA, 530 bp, Mus musculus
atgcaggtctccagcctcaacgaagtgaagatttacagcctcagctgcggcaagtctcttcccgagtggctttctgacaggaagaagagagcactgcagaagaagaatgtcgatgttcgtaggagaattgaacttattcaggacttcgaaatgcctactgtgtgtactactatcaaggtgtcaaaagatggacagtatattttagcaactggaacatataagcctcgggtccggtgttatgacacatatcagttatccctgaagtttgaaaggtgcttggattctgaagttgtcacctttgagattttatcagatgactattcaaagattgtcttcttacataatgacagatatattgaatttcactcacaatcaggcttttactacaaaaccagaattcccaagttcggccgagacttctcttaccactatccatcctgtgacttgtactttgtaggtgcaagctctgaagtttatagattaaacttagaacaagggcggtacctgaatcctctccagacggacgccgc

SEQ ID NO: 2037 - protein, 177 aa, Mus musculus
  VARIANT (1)...(177): Xaa = Any Amino Acid
MQVSSLNEVKIYSLSCGKSLPEWLSDRKKRALQKKNVDVRRRIELIQDFEMPTVCTTIKVSKDGQYILATGTYKPRVRCYDTYQLSLKFERCLDSEVVTFEILSDDYSKIVFLHNDRYIEFHSQSGFYYKTRIPKFGRDFSYHYPSCDLYFVGASSEVYRLNLEQGRYLNPLQTDAX

SEQ ID NO: 2038 - DNA, 139214 bp, Homo sapiens
  misc_feature (1)...(139214): n = A,T,C or G
tggtctgtcctactgccaagccacctgacttcattcatcagtccctagaatgcttcatcaatgcagacaaacatctcagccagccttttatttctatttctacttgttatttttttgagaaggagtcttgctctatcgcccaggctggagtgcagtggcacaatctcagctcattgcatcctccgcctcccgggttcaagtgattctcgtgcctcagcctcccgagtagctgggactacaggcacgtgccactacgcccggctaattttttgtgttttaagtagagacagggtttgaccacgctggtcaggctggtctcaaactcctgacctcaagtggttacaccactccagcctgtgcaacacagcaagactccttctcaaaaaaataaaaaataaaagttttttaaaaatacaaaaaatgaacaaaattagccaggtggggtggtgtgtgcctgtagtcccagctacttgggaggcttcagtgcgaggatctcttgagcccgggaggtcaaggctgcagtgagccgagatcacaccattgcactccaacctggttgacagattgagactctgtctcacaaaaaaaaaaaaaaaaaaaaaaaaaaaattcttaagactttttaattgcaaaaaagagaaagtaagttgtaaatctacaaatatcctagagttcccatttaccaccccccgcctcgcacccagcactctggttgttaacatcatacataaccctggtatatatatcaaaatatgaaatgaacactgatacaatgctgtcaactaaactgcagattttattcagatataaccagcttttccactaatgtcctctttctattccagcattgagtccaggacaccacattgactaaagacataattcttttaaatgttacttaaagatgtacaaatagaaacctagttacaaaatgtattatgcttttaactcttgtattattataaaccaaaccaaaacaaatttatattttcttttttttttgagacagagtctcgctgtgtcacccacgctggagtgcagtggtgtgatcttggctcactgcaacctccatctcccaggttcaagcgattctcctgcctcagcctccggagtagctgggattacaggcatgtgacactatgcccggctaattttttgtaattttttttttttttttttttgtagagacagggtttcaccatattagccaggatggtctcgatctcctgacctcgtgatccgcccacttcggcttcccaaagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgtaggagtgccccataatcagatttgcctgttagagagaatgagtttgtctcttatgggaggcagacttgaggctgggagaacaggaaaagggactacagtgggccaggtaggagacaatgaggtctgaactcctgcggcagcaggaacagagaaggaatctgatattggaaagaaggaaccaaatgcttcggagacctactggccatggaggtaaagaattaggagaggagccaggcgcggtggctcacacctgtaatcccagcacttcggaaggctgaggtgggaggatcacctgaggtcaggagttcgagacccgcctggccaacatggtgaaaccccgtctctactaaaaatacaaaaattagcctaaaaaattagccaggcatggtggcatgcgcctgtgatcccagctactcaggaggctgaggcaggaaaatcgcttgaacccgggaggcagaggttgcagtgagctgagatcccgccactgcactccagcctgggcaacagagtgagacactgtctcagaaaaaaaaaaaaaatttaggagagcaagcttgaatgttatttgaaggtttctggaatggcaactaacagcagaacatttaaggttagttggaatctgtaacaactagtttttctggaatagtttttaatgttttggttttctaataactagcacttatgtagtgttctgtgtaaggcactgttctaagtgctttatatgcactttattttattgactctaaaagaccattacctataagatgcaccattccctcaagatatgcacgatacactagactcatcctttcagagatgctaaaaaaaaatgaatgtcctgaaatcagtgatttatggcgtaaactcacttttctgtttttttgttttttgagacagagtctcgctcttttgccaggctggagtacagtggcgcaaacttggctcactgcaacctccacctcctggctcactgcaacctccacctcctgggttcaagcgattctcctgcctcagccacctcagtaactgggactacaggtgtgtgccaccatgcccagctaatttttgtatttttagtagagatggggtttcaccatgttggccaggatggtctcgatctcttgacctcatgatctgtcctcctcggcttcccaatgtgctggaattataggcatgagccaccatgcccagccttttttttttttttgagacggagtttcactcttgttgcccaggctggagtgcaatggcacaatcttggctcactgcaacctccgcctcccgggtttaagcgattcctgtgcctcagcctccagattagctggaactacaggtgccaaccaccacacctggctaatttttgtatttttagtacaaacagggttttgctgtgttggccaggctggtctagaactcctggcctcaagtgatctgcccgcctcagcctcccaaagtgctgggattacaggtatgagctactgcgcctggtcatgattagtttttttttgtttgtttgtttttgtttttgagacggagtctcggtctattgcccaggctggagtgcagtggcgccatctctgctcaccacaacctctgcctcccgggttcaagcaattctcctgcctcagcctcctgagtagctgggactacaggtgcgtgccaccatgcccggctaatttttgcatttttagtagagacaggggtttcactatgttcaccaggctggtcttgaactcccgacctcgtgatctgcctgccttggcctcccaaagtgctgggattacaggcgtgagccaccgtgctcagcccatgattaggtcttaagggcagagctctcatgaatgggattggtgcccttacaaaatacaggttgagtatccctaatctgaaaatccaaaatctaaaatgctccaaaatctgaaactttctgagtgtcaatgtgatgctcaaaaggaaatgctcactggagcatttcggacttgaaatgtttggattagggatgcttaactggtagacccatctctataaaaacaaaacagccagctctggtggtgtgcctgtactcccagctactcaggaggataaggtggaaggacagcttgagctcgagtttgaggctgcagtgggtcatgatcatgccactgtattccaacctggacaacaaagtgagatgcccccatggaaaaaacccacaaccccaacagaaagtagattagtggttgtctagggcttgggtgggggatggggcatggagtgaatgctaattgaggctggggtttctttttgttctaaaaatgattgtggtgatggttgcagaactctgaatacactagaagtcattacattgtacattcaatggggacattttacagtatgttaattatatctcaataaaactgttaaaaaggaaatgttaatggaatttggatacatttccacttatttggtatatggctttattttcagttttattttacaaacacttacatggtcttactatgtgccaagtactgggttccaaacgttttataaatatgaatgtatttcatcctcataactctgtgaagtggatactactgttatctccattttacacaggtacagagaggttaggtaacttacctaaggtctttcagttaaaaatggcagtcgggatttgaatcttgccagtctggcttcagagtctgtgatctttatttatttttcaagagatagggtcttgctgtgttgcccaagctggagtacagtgttagtcacaggcatgatcccattactggtgagcatgggagttttgacttgctccatttctgacctgagccgcttcacacctccttaggtaacatggtggtccctggctcttgtggggtcaccatattgatgccaaactgaggacacccaacgctcgttgcgtgctacagccaagaactcctgggctcaagtgattctcctgcttcggcttcactagtagctaggacaataggcctgcaccaccaagccaagccagagtctgtgatctaaccattctattatgccacctttcccaaagatgtttacagtttttcttaactgtaaccagtgtagaaaattaaaaatttgtggaggatcttaaatttgaggacagagttaaggaatatatccctacgtacatggctaaatgtaaatatgtagcaatgcctaatagaggccaggcactgttctggtactctgggtaggggtggatggggtggatagggaatataaggacaaatgatatagggtccacgaagaactctcaacctaattctgatgcaatgtggtgttggtatttgagagtttccaaaatgttgtgggtaggagagcaaaacaataatatttgggttttagaaagtaaggcataaaataatttgttcattaaatcaaaggaagtaagaagatcacttgggaaagttataatccaaaaatagttaagtatttgagtttcagcaggaggaatgaaaacagattactttaaggaaatatttcataattagaaatatccaggtttagatactgaaagtgagggccagagataggaatgggttgaagatgacgccacagtcttcttttttttttttttttttttttgagacggagtctcactctgttgcccaggctggactgcagtggcacgatctcagctgacggcaacctctgcctcccgggttcaggcgattcccccacctcagccttcagagtagctgagattacaggcgcgcgccaccaggcccgactgatttttgtatttttagtagagacggggtttcaccatcttggctaggctggtcttgaactcctgacctcaggtgatccgcccgcctcggcctcccaaagtgttaggattacaggcgtgagccaccgcacccggcctacagtacttctaacgtaacatcgcagaaacactggaggagagaagagaatacacttccactcggaattcgcaccctggtcgccttcattcgctgggttcactcgctgaactgcctcgcccccgcccgggaggatgacatctcggcctgggcagagactcgaaagcctcctcctgccgctcgggatgctaacagcagggagagctgtgtctagtttttttttttttttttttttttttgagagggaatctcgctctgtcccccaggctggagtgcagcggcgcgatctcagctcactgcaacctccgcctcccaggttcaagcaattctcctgcctcaacctcccgtgtagctgggactacagatgccggccaccacgcaaggctaatttttttgtatttttagtagagacggggtttcaccatattggtcaggctggtctcgaactcccgacctcaggtgatccgcccgcctcagcctcccaaagtgctgggattacaggcgtgagccaccgcgcccggcttgtgtctagtcttgcccgtagcagcgtcgccgacagccacgccgggttgtcagagcctcactagtttttctcccggccgccgctcttcccggattcagccaccttccctcttccgggaacttgcccgcgtgttccggctccaggaagtgcgtcatcagtcggcgccagcggccgcacgccgcggagcaggggctcggaggtcccgggattacggtgctcgagcacgctggtgggaaaggacccgggacttgaacagtgttgtgcggcgccatgcaggtctccagcctcaatgaggtgaagatttacagcctcagctgcggcaagtcccttcctgaggtgagtcacttcccggccccctcactctcgagctcttgggggtcgtcctcctcgtggggcagccgcccctctcctcggccctagcctctgttttagctggacgctggtcaccccccgactcggggaggcccagaggcggctgacaatttccgggggaggtgtcggcattgggagacaaggacactgccgtcaccgcgccagaaactggaccaagggataatcagggtcagtgagctttgctggaacttttgtaaagttctctgttccagagaacgcaaccatttgggcctctttgggtgttcacagtccctgccgtacatcgaggaggaaaacgtggcagattcgttgacacatctctcccccatatggccatcagctgtttgtggagtccctatcatttgccaggtcttagggatacaacagtgaacaagggagatacagacttcgcatctgcagaatttatggtgtagaggacagtattttcgagacttgttgaacttaacctgattcctagtcttaaagttggagagggcttggacaagtcggtaattctcttccaatcttctcgtgtttagtaatgcagctgagatttaataatgcgtttaatatgcagctgagatccagcaaggggaagggtgacttgtccagcatgacacacttaggctctgaaacttgtcttttgtttcttatacgtgatgatccagcctctgtccaagcactaccactgagcactaccttttgtggaagctcatttccattttgagactctgcacttgttagaaagtggttttcaaatatgtcaccttatagcatgccactgttggcctgagtcctgcccttggaaaacagaataaatatagctctccttccatgcgtctgcttctacaaaaatttggagccagtgcttaggtttttcctttcttcctaaaattctggtttgaataattccctgtcttccagttgttcttcacaccccatgagctttctcattttgttcattcattctccacatgtattgagaagttactgtgtgcaagcaactctgttttaagtattgggatctatagtggacatttcagataaggttccctgttggggaaaagggaaataaacaagtgagcaaataaggcaatttaaggtagtcaaaaagtacttttcgtgatgaatgattagaagagagctgttttggataaaatattgagagaaagtgttttggataaaaccttcggggaaggcctctctacaagaggtgacatatgagcagaaacttggatgatgaagaggagccagtcgtgtgaagatgtggggaagagttttcagtgctgagaacagaaagtgcaaaagccccacatgggaatgcactggacatgtaggaggacggaagaggcacaggtgtgattgcactatgctgagtgagggggcgagagcagggtggatgaggctggagaggtaggcctggtaggaaaggtaggaagttcaagttttattcttagtgctgctggaagtcactgttgtgtgggctgctgtgcgacaaatgtctagctggggagggttcaagtcgggatgaattaggtagtccaggtgagcgacttcggtggcttgggcttgcctggtaacaaagaagatgctaaaacacagtgagattcaggacatactttgtagatagggtaatggaacttgctaatggattggactgttggtagagggaagttgaggtgacaaaaaggaaggaatcagagaactcttcagttttgagtctgaacaagtgggtgcacggtggtgctgctaactgacatggagaagaatcaagaaggaacacattgaaaggtggagaggaggaacgtagtgagcaaaaagaatcaagatttttttttgaggtcgcgtgcaatggcctgatgttggctcactgcaacctctcgggttcaagcgattctcctgcctcagcctccccagtagctgggactacaggcacgtgccaccacaccagctaatttttgtatttttagtagagacggagtttcactatgttggccggtatggtctcgatctgatcttgtgatccacccacctcggcctcccaaagtgctgggattacaggcatgagccactgcacccggcccaaggtttttattttcaatagtgaacatttgaagttctaatacataccaaatggagatgttgagtagttagcagttgcatggatactaggatggagattgcaggtgaatttactgtcgttatttgggactaggtgagatcaaattgtgagagaaagaacagagaagataactaggctgaggacctgaggcagtcttagcatttgtcatccaagaagaggaggggaacccagcaaagaagaaagagtagtgggcactgatggaaggggagactgggaaatgtgtagttttgtagaagtaagtgtttcaaggaggaggtggtggtcacctgtgtcagctgctactgagagcttcagtaagatgaaggcagaaaaacgaccatcgactttggcatgatgcagagcgcccttgaccttggcaaggagctccagtggagtggtggggagggtagcttgagctgagtggatttggaaacccctgcttgtcctgtttaatattttctggttatttctttgaggtgtggtgcctaaactacacgtggaaccccagttgttgtctgatctgtgcaaatattgcttctctccttctgggctttacctttttattaatgtagagaagcctctacgtttactcccctggtgatcctaggcagtctcctggctttaagcacatctgcatatcgataactatcacattgatgtttctagcccttacctctactctgaactggacttgtgtatccaactgtttcttgacatccccgcttggatgtctgataggcatctcaaacttaacttgtccaaagtagaacaccagctttccccccacatttccccctcctgcaacctagtggtcttccctccctcagccagtggcaactccatcccgcaagctgttgatgccaaaaacactggaggctttttgttgttgtttctttgctctcatacaatccactagaaaatgctgttgcttctatcttcagtatagatccagaatccagtcacctccattactgtcactgattcaagacactgtcacccctgactatgcaattgcagttattgcagttgacttctaagcagtttctcagtttccaccctctacccctttattccacagtctgttatcagtaagctgccagggtgatcctctactcagaactgtccagtggctcctgctctcttgggggtgaaaagcagagtcctttgagtgacttttaaggtcctacttgatgttgtgccttcctgccctcctctctgagctcagcggtcactgttctccaccttacactggcctcacaagtctcactgctcgagaccaggcacactcctgccgtaggaccttggcacaggtcctgcctgcctgcttttttcccagatgttctccaggctttgcctcctcatgcctttcaggtcgttgctcaagaggaccttaaccttattcaaaattataattctccaccaacacttcgtctccttttcttgctttattttttccatggcatacataaccatctgacattctaattgttttacttccttatttgttggtgttccctcacttgaaagaaagcttcatgaaaggaggggtttttagatttttaaattttttttttttttgaaacaggtttactctgttgcccaggctggagtgcagtggcacaatcatggctcacctcagccttgacttctctgggctcaatgattcttgcacctcagcctactgagtagctgggactacaggtgtgtaccaacatgcccagctgcttttttttttttgtagagacagtgatcccactttattgccaggctggtctcgaactcctgggctcaagtgatccccttgcctcagtgctgggattatagatatgaaccactgcacttggccaagagggcttttttttccctcctgttttatttactactgctatacctaattactggcatttagtagtactaaataaatatttgtttaatgtattgatgaataaagttaattttcattttcagctccatcacacttttgacttggggctacgatttttattcacacaatttgacctacagtctcccattctggagttaatcagcttttgttgtatttttaatgccgttaaatttattttcgttagttttctagtggttaagcctgtttttttttttttttttggcgggggggggggggggggggacggagtctctctcagtcaccaggccggagtgtagtgggaagatctcagctccctgcaacctccgcctcccgggttcaagtgattccccttcctcagcctcccgagtagctgggattacaggtgcccaccaccacacctagctaattttttgtattttggtagagacggggtttcaccatgttggccaggctggtctcaatcggcctcccaaaatgctgggattataggcgtgagccaccatgcctggccaagtatcagctatttggtcagttatttatctggttttattccttgtaaaaaatatatttctataagaaacattctcctataaatgttttactttttaaattctcacttaaatagattaaattgttccatatatttagttataacccataatatttgaggctttctgctttcctttagattgcttagatgggttagtttttctctatgtaaaagattgtagttcaaaaaatttcttatctggccgggcctggtggcccatgtcagtagacctagcattttggaaggcaaaggtgagaggattgtttgagcccaggagtttgagccttcggtgagctacagtcacatcgcatcattgtactatagactgggcaagcatgagaccctgtctctaaaaaagtaaaaataaaagaaattatctaatgtatgtaagtatacacaagaaaaaaaatccaggagatatttaatacgttacgagtagagttaggattagagaatattttttgcttcctatgttatatattcctatgaagtttgaatttttaaatataagcatgtattgattttgcaagccgaaaaacaatttagctaaatttgttttaaaataaactctcttcattttctttaagtggctttctgataggaagaagagagcgctacagaagaaagatgtaggtgagtattgttttttcccacttcagctgcgttagtgatccatgttctaatgcttttactcatttgctgttatatataagtgaggatttataagaatgcggtaacatgtagtggaaaatgaatgctcttgtcccttttcttttttttcctttgacatggggtctcactgtgttgcccagactggtctctaactcctgggcttgagcagacctcccaccttggcctcccaaagttttgggattacaggcatgagccactgtacgcagctcttctcctttttttttttttttgagatggagtttcactcttattgcccaggctggagtgcaatggtgtgacctcggctcactgcaacctccacctcctggattcaagcagttctcctgcctcagcctcctgagtagctgggattacaagccaccacgcccggctaattttttttgtatttttagtagagatggggtttctccatgttggtcaggctggtctcgaacttgcgacctcaggtgatccacctgccttggcctcccaaagtgctgggattacaggtgtgagccaccgcgtccggccgcctttctccttcttaagaaactttttgttgtggttggtatgttcctggtgggtatgggatttgattttaccttattaactaataagttagcctgttaccgtttcatggataacaatagtagacgcaagactcctgggctagaaatgcagatgttattactcacagcacagtagatagcatgaacatcagcatatttgtgccagttcccctcttgggtctcctggggacacttagcacagtccaggtggatgcttggcacacagtggatttgcgttgtggccgagcaacacagcttgggaagtccactgcttttctggcaagcagtaagcaaacctgtgttttgtccagaagggacaggttacctgtctatcaaggttctcagcagtgtaaacaaccctgagaaatggctcaggtaagagtggctggggtcttgcaatctcgccatacccagtaagcatgcaggtccaaggaggactgtctctcctaacaggtccctaattgctttgctctcttgtgtatcaaaatcttatcgtgtaaattaaatccatttatcagtgtttgagatacagagacaatgagcatttcttgaagaaaggaattttacatgtagggtttatgaatctgaacaattaaaggtgattgcagaagatgttggttcttttaaatttacggcagcaagaaattgtaagaaaaatttctaacttaaataattttggtgcacaagttttcattatattttcttcattatagcttgtcacatatgaaagaaaatttattttcccatatattttgtttaacttactctttaaaaacctaaggtatcaaaggggtttcctcttgtctgcagataattggttccaaaagaggtataagtcagcttcgtagcagtttcttatataaacttaagaggttgggtcaggcacagtggcttatgcctgtaatcccagcactttggaaggcccaggcgggcagatcatgaggtcaggagttcaagaccagcctggccaacgtagtgaaaccccgtctctactaaaaatacaaaaattagccaggcatggtggtgcgtgcctgtagccccagctacttgggaagctgaggcaggagaattgcttgaacctgggaggtggaggttgctgtgagccaggattgtgccactgcactccagcttggacaacaggtgagacttgtctcaaaaaaaaagagtttggagagtttgggggcttaaacctgttacttaggagaaaaaaaagttggatttttgtctttgccatgattgagtagtaatagtggtttaggggcccagtgcggtggctcactcctgcaatcccagaagtttgggaggctgaagtgtgaggattgcttggccctagaagtttgagaccagcctgggcaacgtggcgaaaccccatctctacaaaaaatacaaaaatacctgggtgcagtggcatgcgcctgtagtcctagctatttgggggggctgaggtgtgaggatcgcttcagcccgggaggttgaggctgcagtgagccatgattgtgccactgcactccagtctgggtgacagagtgagaccctgtctcaaaaaaaaaaaaaaaaaagtggtttaatgtttatgctcttcctcctgtaacactggatgtttgatacactgttgtggaaaattttttttcaattaatgatgctactttttttattcttgaaaagtaaaaatgaaatacttagcttagaaaaacaacgtatgagctaaggaaaaaacctctgctgtttaatggttgggctgtgctggtgacctttcccaaggccaggaagcatttgggatgaatttcacctgtttatagttgtggtgactgcttggtacccatttgtcttcttatgatagagaataagcacatgttagttaaactagttgtttttttctctctttttagatgtccgtaggagaattgaacttattcaggactttgaaatgcctactgtgtgtaccactattaaggtgtcaaaagatggacagtacattttagcaactggtaagcatctttttggttatgattttcatgcattttgtaccaggaaatgctgcgatgggaaaggtctttttttttttaaccctaatattttattataaaaaatttcaaacacacagaaatattgaaaaaattgtatagtaaacacccatttaactactacctaaattctgcaataaatagtttactctgcagtatttgatttatcccatgcatctgtctctttgttcatgtatcagtccatcttgtttctttgatgcatttcagtgtaagttgaagataccagtatacttcaccctgaaacacttcagcaagtatatcattagctggagttcaatatttatcagtatttacttatagcctttttcaaggtaaaaacatttatattggtgaaatgcacagatcctaagtttaccatttggttagttttgacaaatgcacacgcttgtgtaactcaaagctctatcaagatacagaacatttttttcctgcagaaaatttctcccacccatgcagagacaaccattgctgattttttttcaatatagacaagtttagcctgtttcagaacttaatataaatgtagtcatacactgtatattctttctctgtgagacttatttcatgtaggattttgtatttgaggttcatacatgttgttatatgtgtcaatagcttcttttttttttttattaccaaaagatatttcattctatgactaagccacagtttatttacccattctccatgtgatgaacagctaggctgttttcattcaggtttttggctgttactaataaagcactatgaacaatcgtatagaagtctgttttgtgggtataagctttcatgtctttggtgaatacctaggagtggaatttttgagtcctaggtaggtgtatgtttagtgttctgggaaacttctaagtcgttccccaaagtgatcatatcatttgcactcctactaacaatgaatgagagttttaggaaaggtcacttataacatgattttctgtataatgtactaatttttaaaaatatctctaagattttacattaacagtatttatcgttatcaaaaaatcatgaaatgtagaaaacttttagtgtgttggagtgttgaacagtatcacccaacctttagtggttgtgattttggcgcgtaagtcctgtatattgtccaaacattttttgctgataacagtattccttttccaaccactttctttttggtaataccttttatacatacacaggccagtctcttttgctttgtgttaatgattatctcagtactaactaacactatctacatctcttagccttcagttttatgttcagaaactggtaaaaagaattgaggaaatctaagatacatggacacccttactgaagactagaagaaactcaaattttcttcattttatagatccagagatattaagtgacttgtctaggctcacagatctagtacttaagaaagctaggatatagatttgttaaatgacactttcttttatgaaatcgtcctctattcccatgcaaaattaatggttccttttctccttctcctccctctccctctccctcttctccctctccctcttctccctctccctcttctccctctccctcttctccctctccctcttctccctcttctccctcttctccttcttctccttcttctccttcttttttaagagtctcactctgtcacccagtctggagtgcagtggcatgattttggctgactgcaacctccgccttccgggttcaagcgattctcctgtgtcagtctcctgagtagctgggactacaggtgctcgccaccacacccggctaatgtctgtatttttttagtagagacagggtttcaccatgttggccaggctggtctcgaactccttgcctcaagtgatccgcccaactcgcccttccaaagtgctgggattataggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgcaccactgcgctccaacctgggcaacagcgaggaccctgtctctaaaaaaaattaaagccccaaaaacaaacgacagtggaataaaggtcctggctatattaaaagttttatgtatagcctttcaaattatgtgtgtgtgcacataaaattatgtgtgtatatatatgtatctgtctatatggatatatatgtacacacacatatatacacacgcatatatatgtgtatatacacacacacacacacacacacacacacacaaatgtattaaaattattgccatacgacagtgggctcatatttactggttttaaacttctcttttttaagctgggtgcggtggctcacgcctgtaattccagcactttgggaggctgaggtgggtggatcacttgagcccaggagtttgagaccagcctgggcaacgtggtgaaaccccatctttacaaaaaatacaaaaattacacagtcgtgatggcaggcgcctcttggtccccactacttgggaagctgaggtgggaggatcactggagcccagggcggttgaggttgcattgagctgtgattgcacctctgtgctccagcctggttgacagagtgagaccccatttcaaaaaaggaaaaaaaaaaaaaacaccaaagaaaaccccacaaaataaccttttttttttctttaaacgaaatcttgggttttgatctatgccagaaaacaaaggactacctcattcttttatttttaagatgtctttgttggaaatacataacataaaatatgaaagtctccgaaattgcacttcacggagatagactatcattgtgaagttagttcctccaacttttgccttacaaagtgccaaagttaggccaggcatggtggctaactcctgtaatcccagcacttaggcaggcggagacaggcagatcacctgaactcaggagttcaagaccagcctggccaacatggtgaaaccccatctctactaaaaatacaaaaattagccagatgtggcggcaggcacctgtaatcccagctacttgggaggctgaggcaggagaatcacttgaatccaggcagcagaggttgcagtgagctgagattactcctctgcactccagcctgggcgacagagcaagaccccatttcaaagaaaaaaaaaaaaagaggccggcctcgatggctcatgtctgtaatcccagcactttgggaggccaaggtgggtggatcacctgaggtcaggagttcgagaccagcctgaccaacatggtgataccccgtctctactaaaaatacaaaaattagctgggcatcatggcctgcacctgtaatcccagctactcagggggctgaggcaggagaatagcttgaacctgggaggcggaggttgcagtgagccgagatcacgccattgcaccccagtctaaatgacagaatgagactctgtctcaaaaaaaaaaaaaaaaagacaaagtgccaaagttaccatttcattgtacaaaattgggatcgtattatatggatcattctccagcactcacctgtgctccccctgtacttttactttatagtacgttttggcagctttccatgtcaatggttactactgaggtctgcctcatccactttatgggctatgtaatattcccttgtgtggatttattgtcatttattcaactattttcctgtcagtggacattttattgctttcagttgctgaccatttataaataatgctgcagtgaacattcttaatatctttggcaggcttgtggatatatttctgtgagttcaatttatgtaagttgaaatatagattgaaagtatggaaacatcgtgtgtttttagggattgtccttcaaagaagttgtatcaattgtatactaatcaacaacagtataggggaatattttatactttcaccaacacagatattaaccgttttttaatctttgccattctggtggacaaaactgtttcattgtttgcatgtattttgttagattacttgtaggtttcttagttattttgtttggttttctatgacttgcttgtttagcttttgctcagtttttccttggggtgtttgagaggggctgcttttacattcctttcttttgatttggttacaattaatcctgcctgtctctgaacaagaagtacactcaatgtatctggatgttttgactatgaaagtatgtctttaggttttacatcacattaattttttgtaggaacatataaacctcgggttcgatgttatgacacctatcaattatccttgaagtttgaaaggtgtttagattcagaaggtgagtaaaaagctaaatttgaattcatgaaaatggctttttatgttgtctgcttttctggttttaaaatgagaatggtttgtaattagttttttattgctgtataacaaattactgtactacaatcccgatggcttaaaacatccatttagtagctcacagttgtgtagatcttaagtctatgcaggttctgtgctcagacaggaggtcagggtgttgaccaggtggagctctgacttggaggtgctgggcaagaatatgcttccacgtgttagtttgtagttcttttagaattgactggcagcttttcttgttttcagagaatgcaccccccccaaacccccaaaataataaaaaataaaaaagaatttgcttccaaatacactcaggttgttgtcagaattcagtttgttgtggttataggattgtggttcccatttccttctggctgtcagctgggggccactctaggcttctagaggctgcatgcatttctcatcacacactcacctccaccttcaagccagcaacagctcatcagatcctccctgtatttcttttctttcttttatttatttatttattacttttttaaagagatagggtcttgttgcccaggctggagtgctgtggcatgatcatagtttactgtagccttgaactcctgggctcaagtgatcctcctaccttagcctcccaagtagctagaactacagatgtgaaccaccatgccccactaattttataattttttgtagagatggagtctagccatgttgcccaggctggtctcaagctcctggcctcagccgtccttttgctttggtctcccacagtactggaattccaggcatgagccactgcacccagccccttgtgttttggatctctctgactttttcttctgctgccagccagagaaactctgcttttatttatttacttatttattttttggagacggagtcttgctctgtcgcccaggctgaagtgcagaggcacaatcttggctcactgtaaactccacctcccagattgaagtgattctcctgcctcagcctcctaagtggctgggattacaggcgcactttaccacacccagctaattttggtatttttagtagagatgggtttcaccatgttggtcaggctggtctcgaactcctgacctcgtgatccacccgcctcgacctcccaaagtgctgggattacaggcatgagccactgcgcccagctgaaactctgcttttaaagggctcatatgattataaatctcccctttgccatagaatgtaatgtaatcatgggagcaatgtcttatcaattcacagtttctacccacactctcaagggaagggggttatacgagggtaaaggtcactgggggtcattcttagaattttgaatggcactgaagtcaagttaaaatgggaaagttcaagtgcttttatcagttggcctagaatttgggattgaggggaaaggagttaatgggatatgtggtctgtggaattatatgcatagtctcccaacttgtttcaccctttgttgtttttttttttatttttactttttagaaacaggatctttttctgtcacccaggctggagtgcagtgttatgatcacagctcactgcagcctcaactacccaggctcaagagatcctcctacctccgcctcccaaatagctgggatcacaggcatgcaccaccatgtctggctaattttttttctgtttttttttttctttcccatagtgatagggtcttactatatctttgtttattgaaaacaatagaaactctgtgtgccactaataatggctatttttcgctctttttctttatcaggtagactatgaatgggtaaaaaatgacatcttttttgttaagcaacaatttttttgttctttaatgtatatttgaaagtctttaaaattattttgttttcaacatctcagagtgtcagaatttagaagtcattatattttgtgaatttgcattcagttctacaagaaatctagttgatgtgtattgagaaattatgaggcttttaagtttttgttggtgttttgggacaatatactatgacaattttcttcttgtttcacgtagaggcagaaaaaaactggtatgtgtataatttctgtgttgaattagaatctttgcatcaggtttgcgttgttactaagaatattgtttgataattgtatttttcctatttcttgtttttcagttgtcacctttgaaattttgtctgatgactactcaaaggtatgttttatagcattggtttgtactgactagacccaagaaatgagtgagtggaatttattttaatgataagcagttttataatatttttattgttaaactaaaatggctgtgtagttctattgttaaacaaaaatggctgtgtagtaaaatgtaacccatcattttttattaatattaatacagtgatacggatagcctttggccaatctaatatcaaaggtaatttttcatatcgtatatgaaaccttatttgtatttttaagaattggcagcagtcatcttttatatcatcctgtattctagatttgtgattctgattattacgtttaacctagatttatttgccaggttgctttcattttcttatttatatgtgaaatgtaaactagcagggttgtgtgtttaatttttttttaactttgcaaatggttgtggtatattctgaaacagttcaaaatatagctaagtagatttatttctcttttttggtgccattagtccatctttcaactctttttttttggagacagggccttgctctgtcacccaggccggaggggcagtggcgtaatttcagctcattgcagcatcagcctcccgagttcaagtgattctcctgcctctgcctcctgagtagctggaactacaggcatgtgcttccacacctggctaatttttgtgtttttagtggagatatggttttaccaggttggccaggctggtctcaaactcttgacctcaagtgatccacctgacttggcctcccaaagtgttgggattacaggcgtgagcaactgcccccgacccatctttcaactcttataatcactttcaacaattataaaattgtcagtaaactcttgaatttaaaatgaaacatttttagtgatgtcaaatggcatcttgaaagaaaattgaattttcttagctgacatggctttatattttcagttttggaaactatggggtacagcttatccttttgtctatggtatcatttatcatacgttttggaacatgtcattttagaatgtattttctctaaatactgacaaatttgcctttaaataccatctgttgatgtttaagatacccctttagtacactaaagtcaaatgtatacaaggagtttatcataacttgtgtgataatggtgggattattattattttttgttttttattttttgagacaagagtttcactcttgttgcccaggctggagttcaacggcacaatctcggctcactgcatcctccggctcctgggttcaagcgattttcctgcctcagcctcctgagtagctgggattacaggcatgcgccaccatgcccagctaattttgtgtttttagtagagatggggtttctccatgttggtcaggctggtctcaagctccctacctcaggtgacccacccgccttgtcctcccaaagtgctgggattacaggtgtgagccaccatgcccggccaggattatttaaatgtgttcccaagtgaaagagggaactgatcattgagggtaccatgagagtgctctatgttatgacatgctggtgccatgtaaatgaagggcgtttgtttcaagtctttaattagtatgtaaggtttgcagaaaagctatcaggatacaggaaggcattaaggagccgatggagtgttttcattcttaatcccagtggagtgtgtgtgcatggacatgtgtgtttagatacagaaagtgagagagaggtaagggttttccttggtttgccagttttttagcgataatgaagtaaacacctaactagaaacctaagcaaactaatttttttgttttattttcagattgtcttcttacataatgatagatacattgaatttcattcgcaatcaggtttttactacaaaaccagaataccaaagtttgggagagatttctcttaccactatccatcctgtgacttgtactttgttggtgcaaggtattggatccagtccctttttctccttttcacctcctaaaacaaccaacttctgttcctaaatttcgtgtacattttctctgtttaggtaacttgctttaataaaaaagtgatacgtggctcttgtaaaaaaaaaaaaaaaaagaaaagaaaacacaggataggcaaaaaattctattttctacatattggtttacttataagtaccatatactgttttaacaactgttgttttgcttaatacaatattttctaatgttaaaaatatctgtgatagttatgtgcctcattgggaaatactgatgggaagtgtgtgagccttttcagtttagcccggttgccacaatttatgagacatagtattgttttatttatctgtttatcttctagacttttgtctcgaccttaagtttgcttcatgtcagtaatcagtttctatctgatcactttgtgattaataggtcatatgtggttatggactctagtttaaaaaaattgggagagggttttattgttattatttttggtaatttgatagtttgatttaatttgatttgcatgaaatgacaaaagcatttaaagcatctttcattatgtagttgatgtcctacattaaacagtctactaaattctgaacaaaagtttattagcaagttttcaaaaatttaaaaaacagttgtttcaaaaccattaagtagtaaatgtatttaagaaactaattaggacagatgtcataactttagaacaccactacctacccatgtctttttgttttgttttttctgttttttttgtttgtttgtttcattttctttttttgagagggagtctcacactgtcacccaggctgcagtgcagtggtacgatcttggctcactgcaacctctgcctcccaggttcaagtgattctccagccccagcctcctgagtagctgagactatgggcgcctgccaccatgcccagctaatttttgtatttttagtagaggcgatgtttcaccttgttggccaggctggtctcgaactcctgacctcaggtgatccacccacctcggcctcccaaagtgctgggagtacagacatgagccacggtgcccggccctgttttgttttgtttttaacaaagcaattagtgtatctttttggctattagtattagcaatttatttacaatatttaacgagataaattgtaggcaaaaattcagtacaatttcaatagaaatatcccttttttttcccctgaaaatacagcagtatttgaaggactaatttctttaaagaagaataagacatgatctttgcttttaagttgctgaaagtgaaggtataattcctacatgtgactcatttaggagtgatatctttggcttctgttagtatggtgctaaatttggagatagacatgtataatctagttgataaagtcagtttcttagccctattgcacagtatttcaaaactttttattctaagtacctttttggttttattattagttttttataaagatggggtctcactatgtttcccaggctggtcttgaattcctgggctcaaaagatcctcttgctttggcctcacaaaatgttgggattacaggtgtgagctactgtacctggcctttattattattattatcattattattattattattatttgagatggagtctcgctctgtcgccaggctggagtgcagtggtgcaatctccactcactgtaacctccacctcccaggttcaagcgattctcctgccccatcctcccgagtagctgggattacaggcatgcgccgccacgcccaggtaatttttgtatttttagtagagacagggtttcaccatattggcaaggatggtctcggtctcttgacctcgtgatccgcccacctcagcctcccaaagtgttgggattacaggcgtgagccaccgctgcccagccctgtgttatttttatggtcatcaaaaaggtagcatttgaccaggtatttgactggtggctattatgtttgtgtgtgtgtgtgtgtgtgtgtgtgtgtatatatgtgtgtgtgtatgtgtgtgtgtgtgtatatatatatatataaaaaataaaaatatatatatatatacaaatacatacccattttagaaaattgggaaaatatagaaaagaaaaaattcaggctgggcatggtggctcatgcttgtaatccagcactttgggaggctgaggtgggcagatcacctgaggtcaggagttcaagaccagcctggccaacatggtgaaacctcgcctctactaaaaatacaaaaaaatagtttgagaccagcctggccaacatggtgaaaccctgtctctactaaaaatacaaaaaattagccgggtgtagtgagtggcgcccgtgagctgagattgcgctattgcactccagcctgggcaataagagcaaaaccccatatcaaaaacaaaaaaacaaaaaaaaagaaaaaattcagccataattacaccacccagagaggatccttattatatttccttctagtcctttcttatatacatatgtagatacattacatatacttttggatcttgtattctccatcttatttgtaaatagtattctacgtaatgacttcatatttccttggcacatgaatggtttaaatcacttttatacatgaacaaattcataaagtggatatttttcagatttagaatacgtttttgtatcagtgttacaaaaggaagtggtggcttatgagtaatatatatatttataaaatttatatttacttaaagtttcattgtagtttagcaggtttttaactttctttattactttacagttctgaagtttataggttaaacttagaacaaggacgatacctgaatcctctacaaactgatgctgcgtgagtattgttttagtaattctgctatatacattttgaccaggaggtggagccagatgctcagtttgttaacaagtaacataaactattgcaattaagcaaaactcccagcaacttagttaaaaagtactgttgaatttattctcagacaaaaaattcactgaaagatctggtgattactttaaaaattaaatgaaagctttttttcatctactcaactttaagtcagttaaaaatactcagtttattattattacttgtagtgttctttaaatttacattcatggttttgttttgtgatattttctcctgtggagaacttttgaattaatttggagtgccatttttaaatttttatgctctgctagcggacatttaaggtttttaaaggtttccttttatcatacattatagtctacacatatgtactatgcagcaaaaatttttaggaatgaatccatcatcatcatcatcacaacaaataatagtgataaacacagtaggaaagcactttgtgccaggtgttattcagtcattttacctttattatctcattttaaacttagaacagatttttgtggtaagtaccattttacagatagggcagctgaggctcagagaggtaagtagtttgcccaaggccacacaactagtcaagggtggaagctggattacttctcattgtgtatatgaagagcttgctgaatttctcgtattgctttgagaggatttttaaaggttaggtgaacatgttgtgataagaaccaaataaactctaatttttttttatttcacattgggtagaaatgcttttatttttattaaaaaaaaaacttgtagtagtaacttcacaaatgcattatattgagtgtcctctgtaccccagatactgctgaacgctttgcagtctttttcatttaatccccataacaaccccccgaggtaggtgaaatatccattttacagagaaagaaaatgagacttagaatgatgtacccaggacaagcctgtcaaggctcaggattgtcatggtgatagcgtgtgttcttttaagaatgttacctgccttggaagaaaataccttgaaaaatagagtgaccctttcttctcatggtagtggaatagtatttcagaaggaagtccctccttgtttgtcacctagcaggtagagtgtcaccctggggatcagaaactccagtgactgagccaagcacttaaccctttcataccttggtgttttccatttgcagattagtaagagagaatctgtgtgtcttctttctactcagaatttgggttgactgtttatttatttaatattccttccccactaaagtaggtgctaactaattcattctttcttactgctttcctgtgttagggagaataatgtttgtgacataaattcagtgcatggcttgtttgccacaggaaccatagaggtaagcatatgttgactttattttttagaatatttgttttatatttgattggaatttttatttaaagactgagttgcttgattccttagagcaggatgataatgaggtgatagcttgaacatcctgtagagtaacattcagtaaatattgagatgaatgtacacaacatttttcttttaaatgataatatctttgaatcaatgtccttcacacttaccaatagttttttgtagatttgcatttttcacttaaaataatgataaatactcatagttttaaaaaatgcaaatatgtcagaagcatgtaattttaaaaagtgcccttttataccttccagtcaccaaatcctacaccccagaggtaacacttgaatggtttggagtagtatcctttcaaattttttttcctaagtgctatatgccaatatgcatatgtgtacatacatattttttaaagtggtttaccaaactgaaattgtattctactgtagttctccatttgctttttttttttagacataacagtatataatatacatcttattggtacttataattacttacgatgctaaactaattttaaaaaaatttacaggccaggcgcagtggctcactaatcctagcactttgggaggccaaggcaggcagattacttgagatcaggagtttgagaccagcctggccaatatggcgaaacaccgtctctactaaaaatacaaaaattagccgggtgtggtggcacacacctgtaatcccagctatttgggaggctgaggcaggggggcggaggttgcagtgaatgaagattgggccactgcactcccgcctgggtgacagagcgagactccgtctcaaaaaaaaaaatgatagtttacagatagcattctgttgtttgtactataatttattaaaccagtttcatatggatggaattaatggttttttttttactcaaattatttttatgttgagagattaatgcagccacaaaaaagaatgaaagaatgttctttgcagcaacatggatgcagctggaggctgttaccctaagtgaattaagacaggaacagaaaaccaaatactgcgtgttctcacttatgagtgggagctaaccgttgggtactcatgaccataaagatgacaacactagacactggggattactggatggggaagggagggagggaggcaagggttgaaaactaactgttggctaccatgctcactgcctgggtgacgggatcagtcacactgcaaacctcagcattatgcaatataccagtgtaacaaacctgcacgtacccccagagtctaacaaagaagttgaagttgtattttaaaaaaagattaatatttgaaatgggacactaagtttgatctgacagatattatgtaaaactatgttgaatgtgtttgaatactgttatgtctaaatcaagctttctcttggtagtcaggttacttgagattaccaaggggaagttttacaagagtttccctgagaaaatagtttttagggtccttacagggcagtctaggctagacaccaggcaatgtgctaagagaagttatgtattagaacgtgctgctcttccagcagctggtttaagaccagcctaggacatgttgaagggataggaggtagggatgctcaaagactgggcttccggaaattccttgattattagcagcttgcagtttcataagcatagtcagatcaggcttaacaaattcattttacattgattttcatattacatctcagattttagtttcttctttagttcttagttatcataatattgtcaaactaaatgtttgcattttgtgctttttgaagtgcctaagaggggaggtttggcaatggaaatattcaaatttaggtaatagaaaatcagtgtgcttaaaaatacattttgtatttacactggaagttatctgcatacccattttgtgtttttggaatgcaacttttcttttttatgtccataaaatttattaactcattttgagaagacatagaagactagaccatttggaattacctgctgtagtttaaaaaggtttcccttcgattattcatctttgcaacatacctacttgtaataatattaaaagattaatgaggtcagaacctcctaagtatattgaagggtttgcttttaaggtagttaatatattaaacaatcttaaaacatctttgtttatgtttttgttttatcattacaaaatcaaatgatagacaagaacacaaagtgaaaagtgtaattcccttccaccctgtcctattcctgtttccttaggtaaatactgttaataatttgctgtgtatcctctcaggtttttctgtttgcacaagcatttttttaaaaacacaaatgttggctgggtgtggtggctcacgtccgtcatcccagctctttggaagtgcgagtgggtggaacgcttgagtccaggagttcgagaccagcctgggcaacatggcgacacctcttctctaccaaaaatccaaaaattagacaggcgtggtgcataccatagatgcagctactggggaagctgaggtgagaggatggattgagcctacaaggtggaggctgcaatacgctgtgattgtgccctgcactccagctgggcgactgaacaagaccttgtctcaaacacacaaacaacgacccctcatttaaaaaagtaaattgcttttttgtggacacaattctagtacatgtatattcacatcattctttgtaatggctaatactcagtttaaatggacgtactacagtttctccattctgtttttttttgagacagtcttgctttgtttcccaggctggactcggctcaccgcaatgtctgcctcccaggttcaagcgattctcttgcctcaggctcccgaatagctgggattacaagcacctgccaccatgcccagctaattttgtatttttagtagagacggggtttcaccattggccaggctggtctcgaactcctgacctcaggtgatccacctacctcggccttcaaaagtgctgggattacaggcataagccaccatgcccggcctgttctgtttttttgggttttttttttttttagacggagtctctctctgttgcctaggcaggagtgcagtggcacgctcagctcgctgtagcctctgcctcccgggttcaagcaattctcctgcctcagcctcctagtgtgtgggattacgggcatgcgccactatgcctggctaattttgtattttttttttttttggagacggagtctcgctctgtcgcccaggctggagtgcagtggtgcgatctcggctcactgcaagctccagcctcccgggttcatgccattctcctgcctgagcctcccaagtagctgggactaaaagcgcccgccaccatgcccggctaattttttgtattttttagtagagactgggtttcactgtgttagccaggatggtctcgatctcctgacctcgtgatctccccatcttggcctcccaaagtgctgggattacaggcgtggccaccgcgcctggccgggattcttcttttcattaaaaaaaattttccccagctttttatttttaaaaagttcacatctttgtaaaagtttagtgatatatatattttgcattttcttttcccataaaaatgtacatgtattaaaaatgttttttgaaccttttgaaaataagttgcaggcattatgatatttcttccctaaatactttaaaatggatttcttaaaaataaggactttttctatgaaataaacaatgttaatgtggtttatttttgtatgtgttttaaggatttcttagcagcttttttttttttttttgagacgaagtcttgctctgtcgctcagactggtgtgcagtggcataatctcggctcactgcaacctccacctcccgggttcaagcagttcttctgccttagcctcccaagtagctgggattacaggcgtgcaccacatacccagctaattttttgtatttttagtagaaacagagtttcgccatgttagtcagactagtctcaaactcctggcttcaggtgatcagcccgcctcggcctcccaaagtgctgggattacaggcatgagccaccatgccccgccttctacagcttttatttaaaattgtttttcatttgcatagggtagagtggagtgctgggacccaagaactcgaaacagagttggcctgttagactgcgccttaaacagtgtcacagcagattcagagtaagtagaaattaatttgcaatgtaaatgttcatcaacttttaatttaagtaatgtgtctatattaaattcaaataaattgctacaggatatctgaaattgtactttccatgattgtttttcataaagatcctctcctgtaaaagctcactagtgagtaagccagatagaatttctttccaaaatactatacagaaggccttatttctttagttgctgtacgattttattaaaacaattacactacaggaatttgtattccaattttgtagaatctagtgatagaaccaggagtccaccacaaagtccacagaggtgtgctttgaattctaaggtggaaggaagcaagtgtttttttaatattttcttgttcctgtttgcctaatttctacatttaaaccaatcagaagagttttcactattatacatccatttacagttttatgattatttcctgagaaatgatacctagaacctgaatttctggattaaatagcatacatgttttgaaggtttttggtacattgctaaattgccctacagaaaacataacctcaggttaaatgtctccctgcatgcccagagcatacattgctcactctcctcagcctgggacgtccatcacagcactgctaataataagtcttagaaagagcctgaggatattgattaaataaagcttagtagaaatagtagctgacagatagtgctttctatttgccaggtactgggtctaagttctttacatatattaacttatttaatacgacagccctttgctgtaggcactgttattgtatttattttatagatgaaaaaaatattcgtcaatggcatacatgttactcagcctttaggaattatgttgcagaagcatatttattactagggaaaggtggtccaaatgcgcctgtcagtggaaaagcgagccatactgttgactatagagtgttaccacattgttatcagaaaaacagtgaacacaagcatagtcataggaagaaggctgggtgtattccagaatgtaaaaactagagggtttttttttttccgatttgcttttaggtaattttattttttaatttttttttaatgcttagctttttcgtttttgttttccctacaaaccttagaagctgtcacttctaggtggagcccatacaatatgagaaagcagtaagtgtaagtgttggataggggaagcaggctgtcattatttgcagatgatgtaagtttctctgcctgagaaactcaggagagtaactgaaaatctataagaactaatatagaccaggcacggtggctcacacctgtaatcccagcactttgaaaggccgaagctggaggatcacttgaggttaggagttcaagaccagcctggccaacatggtgaaaccctgtctctactaaaaatacaaaattagccgggcatggtggtgcatgcctgtaatcccaagtacccaggaggctgaggcaggagaatcgcctgaacccgggaggcagaggttgcagtgagccgaggtcaccccactgtactccagcctgggtaacagagtgagactccatctcaaacataaataaataggctgggcatggtggctcatgcctgtaatcccagcactttgggaggctgaggcaggtggattacctgaggtcgggagtttgagaccagcctgaccaacacagagaaaccctgtctctactaaaaatacaaaattagctgggcgtggtggcgcatgcctgtaatcccaagtacttgggaggctgaggcaggagaatcacttgaacccaggaggcggaggttgcagtgagccaagatcatgccattgcactccaacctgggcaacaagagcaaaactccatcacaaacaaacaaataaataaagtgttaccacatcgttatcagaaaagcagtgaacacaaacatagtcataggaagaagactggatgtatacccgagtgttaaaactagggttttttttctgatttggttttaggtaattttactttttttttttttaatgctttgctttttttttgtttgttttccctacaaaccttataagctgtcacttctagtggaaccaatacgagaaggcaataagtgtaagtgttgaataggggaagcaggctgtcatttccagatgacataagtttctgtgcctgagaaactcaggagaataactgaaaatctataagaactaatataacagttaaataaattggttataaaatgttcaaaaatcagtgaccttgtcagcactatccagttaaaaaggttataaatggaaaaacattctaataacaacaaaaattgtaaaactcgataagaacatatatgggccaggtgtggtggctcacacctgtaatcccagcactttgggaggccaaggcaggcagatcacttgagatcaggagttcaataccagcctgggcaacatggtgaaaacccatctctacaaaaaaatacaaaaattagctgggagtggtggcacacatctgtagtcccagctactcgggaggctgaagcaggagaattgcttgaaccggaaggtggaggttgcagagagctgagatcatgccactgcactccagcctgggcgacgggagtgaaaccctgtctccaaaaaaaatatgtgaagaaaatgacaaaggaataagtagagaagtatatcactatactgaaagaaatgattaagtatactttgaagagtaagtgactaaagttgctgtgcatatgaggcttcgaggttcccacaggtgccccagcgcagttacaggctcaagctctaggtggcagaagagacctgatgatgccgacagccaacagccaggactctaggtcctgggccaagggcatgtggacgataggattgatagtgatattgtccacttctgactcatcgcctagcactctttccactggagatcattgcttttggtgctgattgtcttggttggtatgtgagaagcatattctagagtcgtggccatagcattcactctgtctttggtactttcagaggctctagggtccccatttgaggattagtcttttattttagctgaacttggctaattttaaagtggaaatggtgtacccatgtccaaacaaaactatgtcttcttaagtatgaaaggggatgtttctataaataccttattctggcttaattaaaatggaagaaagtagattacgttttgtatataaagtgtaactttgattatgaaagtttgaataaaattactatttacttactatttttgagacagggtcttgctctgttgtcccagcagagctccactgcagcgcagtggaatgatcacagctcactgcagccttgacctcccaggctcaagcagtctcttgcctcagccacccaagtagctgggacaacaggtgtgtgccaccacaactggctattttttttttttttaattttttgtagagatggtgtctcactgtgttacccaagctggtcttgaattcttggcctcaagaaatcctcccacctcagcctcccaaagtgctggtattacaggtgcgagtcatcttaccaggctgcagttaccttttaaacagaagcctagaaatgtgattcctcccccccccccccattagatttgaagtgaagactaataatgaacttgttacttggaaggaggtttggccgtatattcatgaagcatgaatattttgcttttcaggataaacagtttaccaacaatctctgctttgaaatttaatggtgccttgaccatggcagttggaacaaccacagggcaggtaaatatgtttaatttggaaaccacatgtaagttggtatttcagtggtgtgtgtatgtgtcatgagaaatacactgcaggaacagaaaatgagatcatactattttagccagaccagagggtattccagaatgctggattcttccacaccttgagaaatcttgactcttgccttggtcagtctgcagtgctgtggacttagagctgcagtgggataggcctgcaccaccacacctggctaattttttgactttttgtagagacagggtctcactgtgttgcccaagctggtcttgaactcctgggctcaggcgatccccccacccttggcctcacaaagtgtggggattacaggcgtgagccaccgggcttggccataggtattctcttgttagtggtttggaacagcatttttcagagtctatgcaacagaattctgtggtcagacagtcttgggagtctgccagacttttactcttgaagattgacagtgggtttcaatactgttttaatgaaggctctcaggaattcttgcagacaagaaatatgtttaataaatatttccaaaatttgtgtgttcaaggaacttttttttttttaatatagcatcattaactatagcacatgccatgagtggtcagcagaacatgcattagcagtgctagtctgaggagtacttctttctttccttcaaggcagagcctgtacacttgcctcctacaagaggtctgaaaccctgccttggaggatttactttctttgtcatcatgggctagagggcatctgtcacctgggacttaatcctaggggagctttcccaggcttccttgcctctagtgacgggtccgaagagattctcccttctcccaagaagtcatagccttgccaccaccatctgtcttgatctactaggactgttcctgattatgtctttcatttttgtttatatctgttgctatgacactgcctggtacataggccctcagtatatatttgttgaacaaattaaattcttatgggctttcattttttgttctttcttagtatgttcagtagctcttacaaattaatcttggggttgaattcataaaatgtatactctaaggattatttaagagatctttctggaaagaatctcaaatctcagcaccttgagtaagggtgttcattgtgttcataacaaagcgatgaagcaaatggctgccattattctcacttagaaatatttcctttgaagataaaatgtctagtttgtttaaacagaaataattttttttcaggttttattatatgaccttcgatctgataagccattgctagttaaagatcaccagtatgggctgcccattaagtccgttcatttccaggattcattagatctgattttgtctgctgactctcgaattgtcaagatgtggaataagaactccgtatgtatttttggttgaaattacttgcttctttatttgcaggtgttccgaatgatcctttcctctccctttccttttttatgtgggttattgggaaagagatactgaatatacatttgggaacttagcgggaggtcagttacttttggatagataatatccatatttagataagatactcatgattgctttccttctgttaagttttcccaattatctagaattggcatgcattttagatgttaagttaggtagagagaaaatagtggtttacaaaagttgatctatgacccgagaaaccccctagatattgagattccctcacaggtgtaggaaaagtcttcagagctactaattatccttccatgcatgttggtattattacatatctcaaattcatacttttcctatttgattttttttttttgagagagtttgctctgtcgcccaggctggagtgcagtgccatgatctcagctcactgtaacctccgcctcccagtttcaagcaattctcgtgccttagcctcagagtagctgtgattacaggtgcatgtcaccatgcccagctaatttttgtatttttagtagcgatggggtttcatcatgttggccagtctggtcttgaactcctggcctcaaatgatccgcctgcctcgacctcctgaagtgctgggattacaggcgtgagccacctcacctggccttaaaagctatatttcttaagaatattttgatggtccttctcctcagctctaaatgtcatttgaaatgtaacaaaatcctatattgctggttttaatctgtcttctgcttttcatttttcattttaaaacctaagtattttgagagaatagtaaagagttgatcaaataaatgggaaaaatgcattcagtatagctatgtttttaagagttctttgcatttaattcattagaaacttagcatttttagtttaaaaacagatcacttttaaaaaattcccatttgtgatgaagtcgggtggacggcccaccagcctgagcagttcgtgcctaagcgcaagtgcccgtctattccgtgggggctgcctgtgcccaggcacacacgctgcagacagcccctcacagttcagctgcctgttgagtctctggctttctgggctgttactttggttttttaaatttcattttgttaattcctgaagtatgggtcttacttggcttcttttccttttttctctggatctgtcctggagaccagagctgtgttctacatccctgaggccctcacctaattcataggttctggtgactttgtttatgttacagagaagaacataaagaaaagacaggctttcagtctttctaaattcttggaagaattgccctgatgattgcccaggaagtgtctatgctgtctgctttgttggctttgagtttgaaggattttgagggcttttttaaggaagattcatgatcttagaccagaactttctctgctctttttctggcaattcaaactaattgatgttaaaacaatatttatttttaatactacaaatgcatatgtttttattcttaaaaattcataaaacactggtaaagtagaagttatttatccttgacctggctttcatccaaccaaagggaaagactgttagcaatctggatgtatctttccagaccctttaacttctgcatagtttccatcatgtggattattatcacctttgacacctttttgtcattgttgttccgtgccattataattcctttccctttgcttcctggtttcccctcttttccttcctctttcagtgggaacttgagaagaacagcaggtagctgtgtgaatttcactgttagtcttgggttaggacttggccgtgttcttcatcggacacaaaccatcttgtctgtgctctaacactgctctttttcgccgtgggcacttagtccatcctagtgtcagactttgcataatgagttacaaatgcaagagctggcagaaattttcaacatcacttcttgaaatcatcacactgtaattgctacagtaaattttattttggcattttttttgtttcttatgactaaagacttcctcttgactaacacccacgttacttggttttgcctgacttgcttaccttgtttatctttctcatcacctttttccacacccaccttcttagcatctttttcttttactttccttctcttaatttttaaaagataaaacacttttccccaacagttaaaatagaaatggtttagccctaactacatagtaactaacacttaagtatttgtaggatttcattttgtatttcatatccattgtctcacttgatcctcctcgaaaccttgcggtgcaggcatggcagtgttgtcctcattttccatgctggccatctctctcctctgattggtttgttttcttttcttttttcctttcctttcctttcctttttcttttcttcccttctttcccttcttttctttcctttcttccttccttcctttcttttcttcctttctttctttttttttttggacagaatctcactctgtcgccccaggctggagtgcagtggtgctatcttggctgactataacctccgcctcctgggttcaagcagttttgcctcagcctccctagtagctgggattacagttgcaggccacgatgcccggctaatttttgtgtttttagtagagtcggagtttcaccatgttggtcaggctggtcttaaactcctgacctcaagtcatctccacgcctcagcctcccaaagtgctggtattacaggtgtgagccactgctcccagctgtcttccgatttctttcaatacaagttaagctgggtacacttcacagattatgagagatttttttttaaagttgatgcataattcaaacttcatcttttcttgccatgttgacattatctttaaaatgttgtaatttttcttttttttggacaggtcacttcttctccttaggcctgtttcttcatctataaaatgggattttttgataaattgataagataaattctctaagatttttaagaatttaaattttgtatttgaagtaggctattttatttctttacataggagtagatggttgagttacagcttcagtttgacattgccaaagttgttgttctttaacttttaatacttcgtttttgcttgctatttttagggaaaaatatttacttccttggagccagagcatgaccttaatgatgtttgtctctaccccaactcaggtatgcattctgtagtgaacgttcagtgagacaaataaaaagatgcattctgtagtgaacgttcagtgagacaaataaaaaggctatacttttttaggttttaaacccattttatttcttaagatagaatttggctttgtcagcacaattcttggatatttaacttacttagaagaattaagagcaggaagtggtgtggatgattcagaaaatggcactcttaatgactcagtgctcagcccgcccagctattagtggaacgtggtaacagcatacaggtaggaggcaggtgaagtgctattttagtgtgctctttagctcttttatgtgattagtaatagtgtgtggaaattgagggtagagatttggagaaagctagattgcctgataatacacagatggctcatgaagccataggttttgtaaattctaagttgtatgctattcagcaatttacatgttaggtttcaaaatttaacagtgcattcaaggcaaatctgtgaagaatttcagagtatgggagaaaaatgagaatagtttctactctgagggcagaggtacccagatcatcttgatagagagaagtaaggcagagcgtgagaactcctatcacatttgtgcaaagagtactttgacagcttgctggagagagagagcttttaccctgtgaccaccgagagcggagcagtgagaagattttgctttgcgttgagctggagtgccgagtgagatttggttaggtggagttggggggctgaggtgattctcatgggagagcagtccaagatgaccaaaaaggatgggcacagagggctcggttggggtggggaggagtgtcctgtgcctgagctgtggtggctctgggaaggctgaagtgggaggcagagagtggtgggtggtagagggttgggcatgatgtgctaaatgtcttgggctccgtgtgctgtcagagaggacttgttccgactgtgctttcagaggcaggtctacccactgtgcaaagggtagattggttttggacaaaagtgccttggaagtaactgatattctgagctgagatggggagcacaggtgagagagcaagtttggaaagattatggcttctttttctaacgtgtgaggattaggaggtgacaggacagtggcagtatctggcactatctggcttcccatcaaaatcatctgcacagctttaaaggtacagctcccttgaccttatactaggtgtactcactcatagtgtctatggaaagggcttagaaatgtgtggttttttttttttttttgagttggagtctcgctctgtcacccaggctggagcgcagtggcacaatctctgctcattgcaacctcttctcctgggttcaagcgattctcatgcctcagcctcctgagtagatgggactacaggcacgcaccaccacgcctggctgatttttgtatttttagtagaaacggggttccgccatgttggccaggctggtcttaaactcctgacctcaagtgatccgcctgcctccacttcccaaaatgctgagattacagatgtgagccgccgcgcctggccagaaacgtgtgtttttaacacacttcccggtggattcttaggcggcaagccctgaaccgatccgcagacttgtgcttggggggcgtgtctggcgtccagtagaaaatgtggtcttggggtaagcaggtctgtagatagaaagttttgcgattatcccagaagtggtgggaatgaatgagattactgatagggaaagctgggagtgagataagaagtgagcaggagctggttcatttgggagaatgacggggaggagccagctgagaaaccggatgggaatggacagaacgacagtgccaggccccacggtttttgaagtatggaagagattcagtgggcactgcttagcaactactaaggattacagaagttggggcaggaaggaaagaactaagattgattgcatgctgctgttatcaatctggatgatggatgctgtaatacaaacttatttaatcttttataactgtgtagtcagtggtccatggcttttttttttcttttttctttctttctgtttttttcttacctcttaaggggtcagaaaaattgggtaattcattcagggttggtcacccagctggtgtgtggcagagcctcatttagaacccagccttcctgtttctggtgcccatgctgttttttctttttcttttttttttttgagacagagtctccctctgtcccccaggctggagtgcagtggcgcaatctcagctcacttcaacctccccctcccggattcaagcgattctcctgcctcagcctcctgagtagctgggattacaggtgcccgccaccacgcccggctaatatttgtatttttagtagagacagggtttcaccatgttggtcaggctggtctcgaactcctgacctcgtgatctgcccgcctcagcctccctaagtgctgggattacaggcgtgagccactgcgcccagctgcccatgctgtttctaattgcacactgctctcccaagaaagatgagaaaccctggactttataatttgcatttcatctgtaatagttgagagaattttattataatcatgggagtaaagtgaaattctggtgagttcaggaatagattgcagctgaggatgctgggtcctagttagggtattgaaatgacctacaccagggtctcggttaagtaggtaagtgagtaaatcaggtggagctgaggttggggcaagggtgacgagcagggatagtgcgactgggggagtgacagtttgaagggcacagagagttgggagagaaagagtcttaccttgggctgtacagtttggtagccactagccactcgtgggcattgacatgtactgtgagtataaaatatacattggatttaaaagacattctacgaaaaaaggatgtaaaatagatcattaataattttctattaattacatgttgaaatgaaaatattttagacctgttggattagtaaaatatattaaaattaattttaccatttttaaaaatgtggctactaaaaattttaaaatcacatatgtggttcacatgctctttccattggacagtgctggtctaaactgggagagcttcaacccttgaggatgctggtaaggtttagtagtgcttgtgcctggcccagtgtagcggggattgttgagcctggtaggctgcctcagtttttccattgtaaccaaggatatagaagcccaaagagacacctgctgaaatgagtgccaatctgttggcccccgcaggctgtgtgcctaaacagcttctccaggaggcagggctggagggtggactcttgtgggcaacttgatttctcaggtcagtttttgtgcatctcttcccccacctttaatggctgtaaagatctcttaacccacaaagggtgtgactacttggcaaagaagcctctttctgagaaatactcaggctcagactgttgaggaacccattcttgaaatgccaccactgacgacagtggttggaatcacaaggacaaggagaggagggaggctgatgttagcagtgcatgttgttacccaggtgactgctgaggaagagacttaaaatggattgagagggtgctgataattcaactacgcatctctggaatgctgattttattttttcgcctggtctgtatttatttattttttcagagacagggtttcacattgtcacctaagctagagtgtagtggcacaattatagctcactgcagccttgaacccctgggctcgagcgatcctgcctaggcctcctgagtagctgaggctacagatacgcaccatcacgccggctctcccctggcctcacgataaaaatttaaatgatttgtcatttaaaatggcataaaaattgtaaaaataagcatgcttttaaatgaaatttaaaagtgtttctctctgggaaaaacgcccaaaacacttatttaatgaagattgttgtggcctagtgcagtggctcacgcctgtaatcccatcatgcctataatcctgaggcaggaggatcacttgaggccaggagttcaagaccagccttgtcaacacagcaagactctgtctctactaaaaataaaaaaaattagcaggaagcagtggcactgtgcgcctgtagtcccagatactctaagggctgaagcaggaggatcgcttgagcccaggagtttgagtttatagtgagctgtgatcttgaaactaactgtactcttgcctgggtgacaaagcaagacctaaaaaaaaaaattatcttgctaacattttaattgtagaagcatttatagcacagtgattttaatagttacttattaaagtaatatttatgaagaaatgtttgacaatttggtcagaaaacattcttaatgagtagcattttaaaaagtctatttggcaaactgacctataggccaaatccagtccaccacttggtaatttgcagcctttgagttaagaatgggttttacatttttaaatggttggaaaaaaaaatctaagaagagtaatattttatgacatggaaattcaaatttttgtgactgaaattcagatttcagtgtctttcagcataaagttttatgtgaacacagccacccttgttcgtttatacattgtccatgtggcttttgcagcactgtggcagaggtgagtagttttaacagtgaccaggggggctgcagagcctgaagtgtgtactgcctggccctttacagagacagtttgctgacccctggtccatattactaatataaacaaaaatggtcactttatccacagtatttaattatgaagaatttcaggccaggcgcagtgtctcatgcctgtagtcctagtactttgggaggccgaggcatgcagatcacttgaggtcaggagttcgagactagcctggccaacatggtgaaaccctgtctctaccaaaaatacaaacttagctgagcgtggtggcaggtgcctgtaatcccagctactcaggaggctgaggcgggagaattgcttgaaaccaggaggcggaggttgcagtgagccgagatcatgccactgctctccagcctgggcgacagagcaagactctgtctcaaaaaaaaaaaaaaaaaaaaaaaaaaattcaaacatacagaaaagttgaaaaactggtagaatgaacatctttatattctctcctcaatgtttgttattgttgtcttcaccataattgatttatttatctctgtgcttctgtggttgttgtggtttctttgtggaatcactcgaaagccagctgcagacatggtggcactcacctgcacccagggtggcattgatctcctgaaaatcattgaaattattaggtcccttattgtgcctaataaaaatggcagcccttttctaatattatcttacatccagtccattttcaggttttcctaattgttccccatatgcccttttttagttaggtgtggtttttttgtttgttttttgtgtttttttgaaccaggatataactgaggttgtgtgttacatttcgctgttgtgtatctttagtttctttcaatccagtatagtcccccacatctttttcttttcttctccatgacgttgacttttcaaagatcaggccagtggtctcagaatatccttcatcctcgatttatgtgatttttttttctcgtgatgttgtttaacttgatcctctaccgtgtattttttctaaaatagaagttaagtctaaagacttaattaagtttagattaaatttggggcaagagtaatgtgcaggctgctgaggtctccaggtcgttgcagtattggagaggggtaaggttgatcccattgttaagtgatgtcgtcattacaaagtacagtttcttgcaaaccagcaactttaagcatgatgttttggacaaaggaatgactgttactatctaataactcgtaagaggttaatcaagagtagaaaagctagccaaataatttatttcataagagagcaggcagaacaagacccgtaggcgccccttctttgtggcttggatctgagtgtggcggatgattgcactccgcttttccttgctttcccacaccttttcctcccgttcaactctttgtgtctggtgcttaatcattgtgggcttaatcatagtttagaaaagctgaaactgtctttcttttttcttttcacttactcattttggagtaattgaagcataatcatgattatggttttgtaatatttttcttataccaaggctgctcagtatattgggaaatggttctgccttcctgccttgttcagggccctgctcctatggctcatcagccacctgtacagtgagcagctgctccatgccggtcagggcacttgaagagacagcacggctctatgacttgggtgtgcatcagattcatgacacggggagcttgtaaagcttacgtgtgtcttgagtcccactccagacctgtggaatcagcatcggtggtttcagaaccatggtagagagaaaagaacaggggcactgggctcaagaaagatccaattcaggcttaatagtggtagaaattacccaacctcggaattctcacctgccttacaggactgttgaagactacctgtactgataagtgtgaaatagccttttattccgtcagtgccttctaaatacatggaaaactgttagagccatctataaatatctttggtgccttgtatagtaaactcaaatgccccatactttcatctgaggttctaaatagggcaggagcgcccctgccagtcccctttggcacagttctgcgtgcacagcctgtctcctctgagctgttcaaggtggtgactgatgccatatgtttttgcgcagcacttcccaacacgtgtggtgaaggaccaggattttggttttttgttttgtttcgaattttctaatccactgcacgttgatacgtctgtaaaagacaatacaaatgaattactaggaaaatgatcacacatttggttgtcactgcagtgttgaattgcaggtttctaaatgcttcttttcaatttctgcacttatttcctggcctggtaacagtttgcagtctgtcactggggacacactttgagcagctgtagagcactgtgtttgtgttgtgaacttcagtgagtcctttagtccccagagcacatgcagatgagtactgatttgtgcatgtttctggggagggcactattttgtcaaattctcttttattgtattattacagcgtacagtgcactgcatactatacactatagtgtactgggtcatattggaaatgtgttcttttgactccaggtgctgatatcttttccttcctttaaaaatgtatagttttattgtggataaactacattaaaataaatttaaaggaaaaaagtcctcaatgccataatctctttacacgtactgtcacgtactattactgtcttcatgggtgaaaccatattaattctgtgttcatatgttttaagttgtcctcacactgtacttacggttatcttttgcttttcagtttgatgttatattaaacacatctttcacgttgccatgtggtattcatactgacttttttaaaatggtttcttacttgatcatgcaggaggtcttttaattttaccttagttgatgaagtgtcagagtcccatgttatgagccttggaattggtagactgtcagtggctctacttactagctatgtggtggccctgagcaagggaggtaacttgctgagaatgtgacttgcctggcgcgatgctcatgctcttctcttctcctgccttgatcatcttaatttctgctgaactaaggctttctttcacaggtttatttttctgtttctgcctgttagaagctgctcatactctttgggctctatgatgttctttttctcattcataattgctttcagccctgaccctcctcacttgagtttggtagtagacctgcttgtatcattagccgtatgtggttgtgtgagatcctcctccatttttagaaaacagtctagctgtgtccagtctgaatttttttgtgtaattacattagagccctttccgtggtttgtttggtaggtggtgttgtatttcattgtggaatgttcattgttgagtgttcagggttgagccagtggagaaggcttaggagaggtctttattaggaaccttccttttggttgtgaagatgtggcttctgtctccagaactgctttaattatgtccaaaggctcctggagatctttcagcagtgttgttagtggagacctaggaagcacaatcagcagaggcagtttctgtccatcatgacctcggtgaacgttgtttggaaggccagaaaaagtgctaagatgaaagattctacaagagttacaagctatgaaaaacagctctgactttgttttggtttaatttagacattattcttgcttttttagacttcattaggtgcttttagatgtttttacggggtgtgtgtgtgtgtgtgtgtgtgtatgtgtgtgtgtgtgttttgtgtgcatatatttttggtgacctgttggtcccagttcagggctagctcacacttctgagttattggcaagacgtggttttggtaagatagtatcgaggccagatgcggtggctcatgcctgtaatcccagcatgttgggaggccgaggcgggcggatcatgaggtcaggagattgagactgtcctggctaacatggtgaaacccccctccactaaaaatacaaaaaattagccaggcgtggtgggcgcctgtagtcccagctactcgggaggctgaggcaggagaatgacgtgaacccaggaggtggagcttgcagtgagccgagaccacgccactgcactccagcctgggcaacagagcaagactcttgtctcaaaaaaaaaaaaaaaaagatagtattgagttcctgcttgagtggtaattgactctattcactcagcatctcatttctgtaatagagtcaaatatcatcacttttacaaacttttgtgttaataaaaggaaaggcagcaaaaaatatttttaaaaacagaatctaatcattgcccttaacatttggtatattcatttatcattatgtgatctgataatctaaatgtcttccctctgtggattcctcttgtatcttacaaatagatttttaaaatgaattcttatttagctgatctgtagaagtctttatttaaaagcaggcgctcttgagtttgactttagctttaacattctctcacgactggggcatcagtccctctgagctttattttctgatcagtaaaatagggctgatgatacatcttctttgagagggttgttgtatgttcactaagatagtatatgtgaaagtgcctagatgattatgaaggactggtcaaaggcttgctggtttcagttttatttaaagtgcagtggtccagagcaggggatctgaggagttttgatgtttgcatattgccatgttggagctgcttcagaacacttgtggggaaggagtatgttgcaaaaatggcagagaaaagggaacaaaaccgagatatttgaatactttgatactaagtagtttagtaccaaataataatgtacttataggttgctcctggggttatagagaatcctttattgaatgccggaaagttatctctttcttcagttttgctttcttatatgctgatcccaaggagactcaattattaaccaccctgttggttcagtctgttataattccctgtgagggagtgactgtgctgtagtcagggctgttagagtccctctaggactttctggtgtagatgataacaaaatgtagacattttgttttgcagtcagttttgtaaaagttaggaatttgctttgcaaaagcaaagcaaatttgttctggaaaattcgaatttgttttgtaaaagttaggaatttgctgtgacattttgtgggaaatactatactttggttcactgactaacagaagttcctcaggcatttcagaatggaaagcaaatagaaaagggtactttctttttcctatgcattgacctttttcattgtatttatttttaggcatgcttctgacggccaatgaaacccccaagatgggcatctattacattccagtaagtaatacaaagaggagtttcagtaaaaataggacaagcaaagatactttttattatttatttaattttttgagacggagtctggcgatcaccgatgctggggtgcagtggtgcagcctcagcccactgcaacctctgcctcctgggttcaagtgattctcctacctcaacctcctgtagctgggattacaggtgtacgctaccacacctggctaatttttgtatttttggtagagacggggttttgccatgttggctggggtggtcttgaactcatgacctcaagtgatcctcctgcctgggcctcccaaagtgctgggattacaggtgtgagccaccactcccggccaaagatactttttaaattggatgtattgaggaacctgggtctacatgtggctgtgtacattagacacagtggactcacttttgggttgaatttgctttctggagccagtcaattcatgctcaaacattcttttatgggaactgtttaatatcatgttaaaacagacattataaattagtatttattcttctgatttacatttattttttgtttccaagtatttcagaatcttaaactttcagctgttagtgatccggaggtctaattctgaaaagtctattactcttcaagtcatctcactatagtttgtttcttttaaaaataagttacatatataaattatcatagatcatcctgatcagggatgacatgtagtttgccaaaaaaacctttttttccctccttaaataattcttctcttaaatagccagaagctcccacccttccctttaagtttatagtaaaaaatgaagcaaggaaatacgatttcataagcagaaaaacacatagtataaagttggcattagattactttatactcagcagacatctcccttacctgagatttgagaagagagtagagtgaggggtactgaagatcagaatctgagggaggtgaactctctgtaaccactatcatcttgcaggtatgaaaattattcctgtctatgatagtccttttaaaattgctcagttatgtattttcacacataaaaaaagcatgctgcttgctgttgactctgtggtttcgggatactgacgtgttgttgaaagcacttagagatatttcgtttggttggtagtgaaatgaaggccgttcaaacaggaagcattttggttttcctaagttaccatttgttccttttcccctggactcttgcagatactgcattcatattcctgtcaacttatccatctttccttgtattcacttgttaataaatattatggactacatcaactgtgtgttgggaacgatgctgtatgctggcagtattacagcatccagggtgctgcccttctctttgaggagttactgttgggaatccaacaagaaagtaggcagttgccattcagtgtgaggagtgctaccagggtactgtggtgggagcacgtaggagagaccctgtacccactgagggcccaggagctgatgagaagtgtggttggcactcagggaatacttcccagagggagagactttgaaggagggaccgaaggatagctgcgtcgactgggtgaaggggtggggtggagtgaggtgcccagtgggagaagggtttttttttccttttcagtcgactttcccaggttggacagtagatcggatcttgacagtagagtgggtgcagagctgcgggagcaagtacctcccatggctgagcatttgagcctgtgggggcaggtagaaagccaggttaggaggggtcttgtgagccggctgtggggatgtagggcagggagtcctgacaagagttgtaagcggggggataggatcagacctgtgttctgaaaagattacttttgctgccgcaggggaatgcattaaacaggctctaatctggacgcaacaagcacaggctgtggcagcccacaggagagatgatggcacctgcattacctgtgccaggctccctttctagtagttgtggctctttggggttctgggataatgtgagagaagtctaatctggtaggcagtacttgcagacgattcatccttgaattgcctggtggcatgtctcagaggtgttcattgatagagagctgtatagatcacaagaatgctgccctcagaccagcgttacgtagttttctcccagtttgtgcccctttggggaacattgtcaggagaggcagaataaatcagcttgcccctaaccttttcatcatgagaaaggtctctttcatcttcctcttagaagtgcttattgtattttgatcactacagcaacatggacagcaagtgcctgtccatgccttggatcttagatcccttctgcatgtcaaaagtagatagaatcaactagtgggcaggtgaaaagcactctcagtgtggagtgctgcttcgggaggtctgcctagtagaggaggagatgtgggctggagagccgcgttgtggagaggtggggaggggcagtcctgaagacggttgcagtgaggccaccttacaagcctgtgtgaggatggtggccatgggcatagaattgaaagggttgttatggttgtaagagacttgaaattgatgagtgtgggaagtaaggaataggaaaggaccaaggatgacaccccggtttttgcttgggcaaatgtgcagataactatgtcattctgagtccaggaagaggcaggagaatattaaacattattttccctttggtattttctgcattttataaaatgatcttttaaagaaagcaaaacagcttttttgttcatgcaaacaatgtatgcgtattcctatttattctaagtgggttacaaggtatatgaaaataaaaaccagctattccctcttgataatactataactaccattaatatttggatgtattgttttttagttatatttgtgatgttatgtgtgggaagttgtatttttttttttaagctttaatgtttttttttgagacggagtttttgttgcccaggctggagtgcagtggcacaatctcggctcactgcagcctccacctcccagattcaagcaattcttctgcctcagcctcctgaggagctgggattacaggcatgtgccaccacacccagctaatttttttttttttttttttgtatttttgtatttttagtagagatggggtttcaccatgttggtcaggctgatctcaaactcctgacctcatgtgatccacctgcctcggcctcctgaagtgctgggattacaggcatgagccaccgcacctggccctaatttttgtgtttttagtagagatggggtttcaccatattggccagactggtcttgaactcctagcctcaagtgatccaccgcctcagcctcccaaagtgctgggattacaggcatgagccccaaagttgtattttatatacaaattggttcctggtttcttcagttaaccttggaaatattaattctaaggtactgcaattacctaaaacatttttagttgcctctattatatgtcattggctggtttatgacatgtctattatcttagaactgtaagagacccattgtttacttctgattctctggatcagtttcttagggtgggcgtttttgttccaagtaatggtgactttaattagcatgagtatgaggggctggtgatgagaagaagtatgaagtatgaagtgtgaggggctggatgatagccaggtgatgagaaattgccttcttgacaaatgttagcttatcttataagacctttttagtttcaactttctacctgagatttaacagaaagctgtgaaaaaaacatccagagagccctctcctaggtgagctgcatatggggacagtgtgagcagaagttgcttttgctaagcgaagcattatgctgaaacttggacttcagtgttcctttctgacctacctttctgccctgctccctcccacagtactgagtgatattttatagcaccacttgtctttacttggaaactgctctttgtaaactccttcaaagcaaagggagagcccaggggtctgaaagcctgccatttttcataagattttatcaaacgtaccaagttgacgtttggcaggaaggttcatttgaggcctatagaaccaaagaaatgtgtgtttaatgtatgatccatgccaagtttaggaagcctggactgtgatttgtattaacatcttataaatcaggtttgaaaactttttccctccctctttggggcatactgaagatgaaggcaacttagtgttcttttagcttgttaattttttgcctatctgatatcatctttcttgagtaattgaaatctttataaactaatgcagttcctgatacaccaccttctggcacttagatatctctgtagccagcttgtcctttgagaccaaatgggttgtctgcagcccctgtcccattttctcagttctttccttattttttatttttatttttatttttttaattctctcagagaccaggttctattgttttgtttgtttgttttctccagggtctaattcgtctgcagcttcagagactaatgccaagaataatttttcaagcttgctttttcctctgaaacataatttaatcttaggttagttctttataattaacatccttggcaactatgtagacttcagagggaatccaagtcccctatggcacccaacccaaaacctttctgcttaatggtgtttctgttggaaatgctcctgaattccgagcccctagcatatcagggcactcctgcagccactcattgcttggtggtggtggttggggtgtgagtgattgcttgctgcttggtaatgtggatgtgtaaacttgaggaaaaatgtaggaggaaaactatttgtttgggaagctgtttgatttagatggagtctcgctctgtcgcccaggctggagtgcaatggcaggatctcggctcactgcaagctctgcctcccggcttcacgccattctcctgtctcagcctccccagcagctgggactataggcgcacgctgccacgcccagctaattttttgtatttttagtagagacgggatttcactgtgttagccaggatagtcttgatctcctgaccttgtgatccgcctgcctcggcctcccaaagtgctgggattacaggtgtgagccaccgcgcctggcccaagctgtttgatttagaagaataaaagtaattcagttggccaggcatggtggctcacgcctgtaatcctagcactttgggaggctgagatgggcagatcacttaagggcaggagtttgagaccagcctagcaaacatagtgaaaccccatctctactgaaagtacaaaaattaaccaggcgtggtggtgtgtgcctgtagtcccaactactcaggaggctgaggcaggagaatcgcttgaacctggaaggcagagggtgcagtgagccgagaccacaccagtgcactccagcctgggcaacggagcaagaatctgtctcaaaaaaaaaaaaaaaaaaaaaaaaaaaaggccaggcacggtggctcaaacgcctgtaatcccagcactttgggaggccaaggcgggcggatcacgagttcaggagttcgagaccaacctggccaacatggtgaaatcccgtctctactaaagagacaaaaaatcagccgggggtcattgtgggcacctgtaatcccagctacttgggaggctgaggcaggagaattgcttgaacctgggaagcggaggttgcagtgagctgaaatcatgccattgcactccagcctgggtgacagggtgagactctatctcaaaaaaaaaaaaaaaaaaaaaaaaaagggaattcagctataagggtatgtgctttgtttttgtttttttctttttttaatgtcactatttaagatgttataaagaataaatacattactgcacccagctttcaagaatggcagttaggtactgttacgttacgttacgttacgttacgttacgtcacgtcacgtcacgtcacgtcacgtcacgttacgttatttttgaatgagacagggtcttgctctgtcaccctgtctggagtgcagtgacgtgatcataactcactgcagcttcatcctttggggctctagcatcctcccgcctcagctttgtgagtaggtaggactacaggcatgtgccaccaagcccagctaatttttatgctgtttttttgtagagagaggatctcactgtgttgccaaggctggtctcaaactcctggcctcaagcgatcctcccacgttggcctcccaaagtgttgggattacaggtgtgagtcactgcacctggccagttattttattttcaaacattttcttaagaaactcctatattatttctattaaaatattttgactgtttaaaataaaacactgattaaatattttaacatttaccatttaatttaaaatttggaaagtactcttggagcctgcaaatgaggcggttaaaaacatgaagaacccttctaacttgcactagtgcttctgcgtctgttcagaatcgcactggagcttatccagcagttcataaacccacaaaactctgtcttcgcaaatagaggacactatgtgttaagaagcataaggcctcaaaaatacataccacacagcttcacagaggcacgcaaaccaaaggaaatgcacaattggaagccacattttttggaatgtaataaaaggttgtttagtgaatgtttctaagcctctcagctgagtaggtagcacactccccgcagaggtgaggccttctgacgccatcacagggttcaacgctggtatctcctcagggcttcagtcactgggctagggcagacatctgtgctcctgcacctgtaaagatggcaaggcagtaggtgctgcagaattttaggggttgtcagggagatgcttttgaaatcattatagctttgggaagtcagttttagggaaatggcatggacatttttctagtaaatgtatgaatatttgcagtctggcagatttttttcttgctcaatgaagaaatacaaatagatattatagtctttttctcaggtttttttctgtaagggtttttggttttagtgtgtgtgtgtgttttttttttttttttttttttttttgagacagtgtcttgctccgtggcccagattagagtgcagtagcacaatcaacctccatctcctgggtcaagcgattctcttacctcagcctctcaagtagctgggattgcaggtacgcaccaccacacctgactaatttttgtatttttagtagacatggggttttgctgtgttggccaggctggtcttgaattcctggcctcaagtgatccacccatctgggcctcccaaggtgctaggattacaggcgtgagctaccacacccagcctctaagggttttgtgacaaaaacaaatttaggtgcaaacaattttaacttctgtctgtggtgaattgaatttgttagtctagttctaaactccatgactatgtcaatgactgttgtctgttagagaggtacttatggatactttttaatcatcgctatgtgatcttcttcctatatagatggtatcttttttcaagttcagtatttgaaacattactgttctggtgtgttttggcataattttccaaagtcttaagaacacagccttactcctcagcttcattaagaagatacttttttttttttctttgattgaaggtcgcactctgtctcccagggtggagtgcattggtgtgatcatggctcactgcagcgtcacaactttctgggctcaggtgattttcctacctcagcctctcgagtatctgggactacaggtatatgccgccacacccagctaattttgtttggtgttttttttttttttttttttttttttggttttttgtagagacagggtttcactatgttgcccaggctggtcgccaactcctgggctcaagcagtcttcctgtctcggcctcttagagtgttgggattgggattacaggtgtaagccactgtgcccggccaaagatgccatattttatcagctatccagagtatatgttgttttagtttaacggtagatttgacagtatcttgaaaataagtgtcaaaaattcctggatgggccaggcatggtggctcatgcctgtaatcccagcactttgggaggccgaggcgggtagatcacttgaggccaagagcttgagactagcctggccaacaaggcgaaaccctgtctctactaaaatacaaaaaaatagctgagcatgctttggcacgtgcctgtaatcccagctacttgggaggctgaggcatgagaataacttgagtctggcagacagaggttacggtgagccgaggtcgtgctaccgcactccagcctgggtgacacagactctcttaaaaaaaataagaaatacatgaaattcctagatggacgagtgttttgctattttgtctcttaatatttttattttgtcttcctatattataaaagtaaatgtaggagaccaacaagtgcttgtatttgttcagtaaggatatattgagtacggtactaggctgcaggaatatgttggtgaagaaaaccaacatgttctctattgtacactcaccgcccttgtgagcttacaatctaggtgaggggtggtgataaacagatctgtgactaagcgctgtgaaggaaggcagcagggttcagtggcttcctacgcattttccctaagtcaagggtcaggcactttgtatcagtctcttttttatgtagatattttatcagcccccttcttctgtgtagatattatatatagatttgtaaaaatctcccccaccttcatcttaaatttgaatttcagggttggagacttggtgttttctttgccttatgatcatagcacatatctggggcaaaatagtgaatgaccatatttgtcccacaatctctggaaacaaaagagaacagtagagagaatgttggccgatagagaacgtagaggttgagcctctataatccaaaaatctgaaatgcagacgctccaaaatttaaaactcttttgagtgccaacatgactccacaagtggaaaatccaaacatgagacttaacctaaagtctgtttcctgccaaaaattattaaaaatataaaatgtttaaaggtataaaattaccttcagtctgtgtgtataaagtgtatatgaagcatgaatgaatttcatgtttagacttgggtctcatcccaagatatctcattatttttatacaaatgttccaaaagccaaaaaaaaaatcaaaaatttaaaatccttctgatctcaagcattttagaaacaggctactcagcctgtattgcttttcctggacagacgtgtacagtcatcctccctttctccttgaacatacatctcatatgcacatcattttactttatctccaagtggtatttagaaacacagttgaccaggcctccttaaaactctgtgcccagcttctagaaggccacattctcctgggattccttctttcatctagttatctcttttcagtcttcactggctcctcctcctgctgataacgtcctagacttcggatcttgcctctctcccctgacctctgaatgttagtgagcgctaggacttagtccttgtctcttctttatttatattctctcccagggagcttgtttatgcctaggctttatataactaggctttatataacagctgtgtgttaatgacgtccaattttccctctccagccttccctctgagctacagaggtacatatccaccagtctactcggcttctccacttggatgtctaatagcacatcctgtttaatgtgtctacatcagaacttctgatccagctccccacctgcaccccacctgccagggtctccatttcagctgaagccttgttgttgctcactcggctgtctaggcttagagcgcaggagccatccttgtttcctctcctctccacttcatgcctcgtcatccagtccatcagctgtttgcagattttgttccacatccagccatttctcagtgcttcccttccatcaggcctctggattactgtaatactggataactgatctttctgcttctgcttttgtctctcttgtaacctattttccatgtaacagccagactgatgtaaaatattaaaaatataaacaaaacaggcccagtgcggttggtcacacctgtaataccagtgctttgggtggctgaggcaagaggattgcttgagcctaggagtttgaaaccagcctgggcaacatagtgagaccccatttccacaaaaagttttaaaaattaaccaggtgtggtgacatgtgtctgtagttccagctacttgggatgctgaggcaggaggatcccttgagcccaggagtttgaggctacagtaagctatgaccatgctactgcactccagcctgggtgacagagcaagaccctgttgcttaaaataataataataaatatatatatatacacacacacacacacacacacatacatataaacaaaacaaatataaatcagattgtgttactcttctgcttaaaaccttccagtggctcattattttgcttacaacttgaaaagtcttacataatagaaaagcagaaagagactaaagaatcagattctgttttcttctcactcaacagagaatagatctctattaagcattaatctatttacaaagatcaccaaatagtcagactgttaaaccaaatcctcagccactgccaccataaatggggaataacttatgggctgttaaaccaaatccccagccactgttaccataagtggggaataacttatgggctgtatattaataatatatcaatatataattaataccaatgttatgatacattaatatataattaatatatcaattatatattacataagcattattagataagaaatttaaaattagagccttttgcggtggtacccacctgtaatcccaactactcaggagtggagaatcacttgagcccagttcaaatccagcttgggcaacatggtgagaacttgtctcaaaaaaataacggaataactaagtaaaataaaaaagaaagacagacacagccaagttctgctgttcatttggattcaccccgcgagccaaggacaactgtgcttggatttcaggagcccaagtatgttacactctgatgaggaagttttcctggttctgtcaggtgagtgcatcaggtatcttagtgagacctccaaaactgctaaaagataacttccccaaaacatgaaatcatgattctcatatagagatgaaataaatacatcttaaaattttaatttaggcctagtgcggtggctcacacctgtaatcccagcactttaggaggctaaggccgaaggatcacttgagcccaggagtttcagactagcctgggcaacataaccaagacactgttgctattatttttttaaataatattttaaaatttaaaaatttcacattttaatttaacctgtaaattaaatgagggaaccaggcccatggttaaatcaaaaggtaaaattttaatttaacttttaaaaggaaaagtgtaaaaaaggacaaatttacatggaataaagttatattgaattgggaatgtgcaagtagacacaaaatggtctattttggactatttggggccttttccaaaggtataaactgtccaccagacataattcatttgcatgtctatagacaattattttgcattgcttccagttacttacaatttgcaaagttgtaaaataggtcctgtagaatgagaatcagatgatcttgcagggtgtactctagactggggtttgggaaactacacaccagctgtctgtttttgtaaataaagttttattgaaacacagtgagcccattcatttatgtattatctatgcaactttctgactataatggcaaagttgagtagctgtgacagagaccatatggctcatgagccctaaaatattttctcttcgtttatttacttctttacgtctatatttccccattgtaatgtaagacatgaatgcaggggcgtcattttgtctttttccctgttatatcctcagcacctaaagcagtgcctgtcatactgtaggccctcacttaatgggtgtggaaaaattaatgagcacacaagtgagagtgacctgattactgcaatttggagcgtctttgataatggttgtgtactttgaccatggctggtttgcagtgcttcttgaccgtacttaatgccagattgaaattttgcatttgcccttttctgctactactattaaaatatagaaaggcactctgggaggccgaggcgggcaaatcacctgaggtcgggagtttgagaccagcctgaccaacatggagaaaccccgtctctactaaaaatacaaaattagctggatgtggtggcacatgcctgtaatcccagctactagggaggctgaggcaagagaatcgcttgaacctgggaggcagaggttgcagtgagctgaggtcgtgccattgcactccagcctgggcaaacgagcgaaactccatctaaaaaaaaaaaaaaaacagggagaacatggttcatgtgtgccagagtataattttcatacagtaggattagcatcagttctttggctctgacagtgccttcttgtcagccacatctgagaatggtggtatgatgcaatcgttgtgtttgggagtgccaacaaatttttaaaagtaataccttgtccaaaagatttaatagtgattctgttaagaagataggttaattaaacttttttttcctataaaaatccaaaaggagaatatgaaagcaagggcatttagcttttgtcttaatttttttggaatttgtgcagaagttggctttgcatctagagtatgacagccttattgtatgttttaaagattgaaaagaatgccttttgtttttctctccatgcttttaactggagttgctgggagtgctgtacacgtcattccctaagatttgggtttgaatcaggaccacgattggtccagctgatgtatttcagttcaaagccaacaatgtaggatcatttatgtttactaaattgatattctggagaagtccccagtaagagatctctttgccccattagtatatgttgaaatggccctgaatctgttagtgtccgtgtagaatcctaaaaaggatagatcacactttcatctaaagtgcacatttaagcagagccctattagacatactgacagatgtaattttgccagaaattgctcttttatagtaccagtagcaacatattctctttgtttgggaaggtagtgtcagatgaaaagaaaactcttccctagggaatttatcagcatacaaacgatgttccagacagaatgtaaacgggaaagtcgttgctcaaatcttgtccacactaaaggattcatcagtgtgctttaaaggaaaggggaagctttggagcatagaccatcagagctagaagggatctccaaggtcatctagtccagcccttaatttgtagctgaggaagcaagtttttgggtttttttttgttttgtttttcctgagacagtgtcttgctctttcgcccaggctggagggcagtggcacgatctcagctcactgcaagcttcacctcccaggttcacaccattctcctgcctcagcctcccaagtagctgggactacaggcacctgccaccaccatgcccgactaattttttgtatttttggtagagacggggtttcactgtgttagccaagatagtctcaatctcctgacctcatgatccgcccgcctcagcctcccaaagtgctgggattataggtgtgagccatcgcgcccagctgcaagttattgtttaaggtcaaatggcaagttggtgacagctggatctaaaaagcatttcttccttccacattgcatagtagaaataacttagactttggaattggttggacccgagtttgaataccagcattgccatttataaatgtgaccttgaatgagttacttattctctccgaacactagtttcttgagcaacaaaagaggaatgatattgtaaggcatttatgtagaatggatatactcattcagtcatttctcatgttcagctgatttcttgtaatgaacagaattcacggggtccgtgggtggcaaagagtatttggataaaattaagtcattaagctgggtgtggtggttcatgtctgtaatcccagtactttgggaggatgaggtgggaggatcacttgaggccaggatttctaggcagcctgggcaacatagtgagaccctctttctgcaaaatgttttaaaaaattagctgggcatggtggtatgcatttgtagttttagctactcaggggactgaggggaaaaagaataataattatggcattgtgtgagcatggacttttatttagcttttagaagggaatatcatgttgagcaaaataaagctatacacggaaaagattgtgacaaacttgtgaatgtgagcaaggaaaatgagttaagacatgatttgggattgtttagtctgatgatcacttaagatatagattgagagaggtctgttgtgccattagttttgccattgactattgaaacagaaagcagtgataacatctggttgtttaaataagaagtctgattttttaaagtgaagttcattttccccaattatatcatcaaggcgcactctttgtacaaaatatggcaaatacagatgagtagaagaaaactcaaatacccttccactgcctaaagacaaacattaacattttgctgtattttttcaatatttaatctgaaactttgttaatatggtttcttatcttgttttttttcccactaaacatttctttattattataaactcttggaaattattaaaaaatatattttctgtatgaatataaagtaatagttatttttgaaaatacataaatatcagaaaaagatgaaaaatttataaatctcactagtcagagacattcttgccaacatttctgttacattttctttgcatttgggatattttagtggctactgattggatttaaagtgaaatcctgtcagaagttcatttagcttacatcagtttcaataaaagcccttcaagatgttggaggctggaggtggaggggtggtggggggagggagggaggtgtatgtaggggagaggtggagggagcaagcgagcatgtttgcactcttaggcagtttcacttacgtggctgtccattcgctctggggggcatatgtcctggactaaacttgagatgagagggcctttctcaaccgagaaaacgtgttcctaattccctaaggcatccagtttatgtgatcaattaccttctcccccatgcatttaggatggctccagtgatggatcgttgttgggagaattgagaaaagagttactcggttatttttgtgttcttagttgagatgaggaagactgtttgaaaaagtttgcttaaatgtgttgtttcctaatactgcgcatgacagcatcacactgagtgtgattctggtcatttaagacatgggattttttggtatgacgtagtcaccaggtgcaagtctcctgctgtatctggtcctattctaacaccagatggaaattctgacgggcctttcaagtttaggtttgcttatattccatttagtcttatctgcttgactttagaacctgatctttatataagagattaaaccaatgaaattaaacttcagaaatatttaatgcaatggatagagtaggagaaggggaacaattttaaaaatacagttagcggaatgggtgagatggtgcctagcagcagcagcatctataacaaaaagagctctgttggtttcagtcaactgtaagtcaaaggaataaaggttaagtagaatgttggcagtgactccacttgtgaatgggggtcgagaatgtcaggatagcacagtgaaggggctgtcttggggctcttcatgtgcagagtgtacctgtgtgtgttatttctgctagtggtggtaagttggagaaagctcagaaaagaattcaagaattgtgtttccaggcatcatctagatagagaaggcatgattttaggatctaggaaaagagtaagatcatgcaagaaagctaccttgtatgaggtacagaaaatgataggacattggcctgaagacgaaagttttcattgtttgagggtgtgggaagagctgtcagacaatgggaggcagtgaagcactcgcctttcacagcttctaaaaggaggaaaaagacaaatttgaatgaaaaatatgatttactttgaattgagttcaaaatttgaattcagatgtatatttttaattttttattatttttattttttaaaattttaactttttttagattcagggggtacatgtataggtttgttacatgggtattttgtgtgatgttgaggtttaggatgcgattcaaccagtcaccctggaagtgagcatagtatccaaagttgtccctccctccctctctccctccctccctctctctccaaaagatgtgttttttgttgttgttgtttgtttttttttgtttgtttgtttgtttgttttttttgagacggagtcttacgctgtcacccaggctagagtgcagtggcgcagtctcagctcactgcaacctccacctcccgggttcacgccattctcctgcctcagcctcccgagtagctgggactacaggcacccgccaccacgcccgactaattttttgtatttttggtagagacggggtttcactgtgttagccaagatagtctcgatctcctgacctcgtgatctgctcgcctcagcctcccaaagtgctgggattacaggtgtgagaagatgtgtatttttaagatgtcttgattcataataggataaaagaaacaaatgcctaattttattctccaagaaaggtattacaatgataaagccaagcctataagaaagatccggaaagataagacatcttatggaaggtaaaagacctaattttatggggaaaaagtgtggagttctgttttgtgatttttcagttatatattcataactatgaactgggaagcaaggcacaaatgtcaggtggttaatacagattcttttgtaagacaaacaagttgtttgtgactttacaaaggggaaatgtggacttcctattttaatctaaacactttcaggtagtaacagtatctgtggcctttttctcaacaaaggatatcctccccgtttcccatcacaatttattggatcacaagaatagcggacatacagaagcattaatgtgtgacaatcaggaagtaattttctgagcatcctgtcgcattttcaaagttaatttcagttctgattgggtaaaaatgtatgtaattttcatggagatatttgatacacatatgacatatattgtgttagtgtatcagatgatgtttgtttttgcttaaatagtcttacatctggcatgtccattttcttgaaaataaatgacaacttcctattcagatgctagtttgacttcaatgttgaccaaaggccttgtctcctggttccggcatttcctccatcttggtgcttaccaagtcgatctcgttgccattcttattttggatgagatatagtcggacttaaacctagtatttcagtgtcctggttgtgtagtcacttaggtggcgatgtctttagttaacatggccattatctcttctttttttttggttttgttttgttttttccttaaaaaagaaggtagcttatacaagtaagccagaaatttagactacattcttttaaaaggcccaccttatacagaaaataataagaaagttctaggacttacaccatctctactttgattcagtgttctcaaatcccaacgtaagtttctcttctgatgcccacttaggatgtaagctccacaaggcgggaactttgtatgttgtgctttttgctgtgtccttggttcttagaacagtgtcttatacttcataggctttcattgactccatgcatgctggtttaaagtaatgaatattgacccttttaaaatttgttttatttattattattttttgagacagggtctcactctgtctcccaggctggagtgcagtggtgtgatcatggctcactgcagcctccaaactcctgggctcaagtaatcctcctacctcagccccatgcagctgggactacaggcacataccaccatgcctggctaattaaaaaaaaattttttttttcatagagacagggtttcactctgttgcccaggctgatcttgaactcctgagctaaagggatcctcccatcttggcctcccagagtactgtgatcataggcatgagccaccacacctgacctgacacatttttttaatgtattatgaaaaaaatgtattttgtctctcattggttagaggagaaaaaatttcaaatagacataaaagtagagagaaatgtaacaaacccgtcttctacccatccttttgctcccatgtcatcagcttttcccccaggctttttttttgtgggggtggggtggaggtaaagttggcttatactgtattactagcaccgtaaattgctctagaaagtagttattacagattgttaaatgggaacgaatattagatcttgacatgggcacaaatcctcatttggattatatgtttaccttcttgaggaacagaacattattcttggttggaaaacaagtaatatgtaaatgatagtagtgggacattgaaagaaaggttagatctgcctgtccatgtttcttgcatgtctgtacatggttatgtcattcactcattcagtggtctttattttttagagcagtttttggctcacggcaaaattgagtggaaagtacagagttcttatgtccctcccccacacgctccctcaccatcagcactttacaacagagtggtccatttgctgcagccagtgaacagacattgacacatcaccacctgaagttcatagtttacattagagtccactcttggtggtgtacattctgtgggttttgacaaatgtataatgacatgtatacacggtcataatatcacatagaatagtctccctaccctaaaagtcctctgttccacctgttcatcccttcctccaccccacaaaccccgagcaatcactggtatttttactgtctctagttttgcttttttccaaaatgtcatatagctgaaatcatacagtatgtaggcttttcagattggcttctttcacttaatcctatgcttttgagattcctccatgtctgtttgtggcatgatagctcattttcctttatcgctgaataacattctcttgtctggatgtactgcagcttgtctgtccattcacctattgaaaggcctcttggttgtttccagttttggcagttaggaataaagccgctctaaacattctcgtgtaggttcttatgtgcacataagttttcaccttgtttgtataaatgtcaaggaacccaattgctatgtcatatggtcacaatacgtttagttttgagaaattgccagatggtcctccatagtgcccatacctttttgtatttctttttttttttaaattcataatcagtgtttttattattttcgatgatggctcatttctaagttaagtgatgtatactgtctacatttcccatctataagcttttgtttttcctggacttttgttacctaattttgatttgcttaggttattattttttttaatctatggcatgtcttcctatcgctgtgtacaatggctttcagtagaactttttacatcttcaaactcatcagataactgtgttttaatatctttttctgaggacattcctcccaaatccctctgttctgctccacttggggctgataggtccttttctgttttgagacagggtctcactctgttgcccaggcttcagtgtagtggcacgacgaaaaccagagacctttgttcacttgtttatctgctgaccttccctccactattgtcctgtgaccctgccaaatccccttctgcaagaaacacccaagaatgatcaattaaaaaaaaaaaaaagaaaagaaaaatctacttctggagaaacaaattaccttcccatctcttttgtcaggaaactcttggatgatatactgaccaaaacagggaataacctaacagagaggaagacagggattttaggaaaccagagatcacacaggaaggaggtaaagggaaatcccaggatgatggcaaagggaagtccccaaacaacagctgtgcaacaagaataaagacctttttgtatttctgacatcagtgaatgagagttcctgttgctccacatgctcgtcagcatttggtgttgtcaatgtttttgcgttttagccattctaatcgatttatagcgtatagtatcttattgttgttttaatttgcaaatatcatttatttatgttggtcagtcatgaaaatgacacaccatgatttttgtctttttgggcttaactagatagttgtgttaattagttgttagttttgagtatttggggggctgggtcatttattatacaaacatttgttacacaaacacttagtgagcatctttcctgtgccaggaccaagggtgggatatcaaaaactgcactaggatatcaaaggtgtttgaagagatgggccttgctgcctaggagctgatagtctagtaaaggaacagatagtacaggtgataaggaactttggtatacaggatcttacaagaggtaagaaagtcactttcccataagtaatgtttcattcaaatttcgaaggacgttcaggaattaggcagtgatggtggatagaagggtggcagaatcagggagatcatcctgtacagagggagctgaagtaagacccacgagccccggtccgttcagtctgtttgggaagagcttgggtttttcagcggctcttaaggaatgggagatactgatacttctccagtaagactggagaagtatcaggacttaaagccaaaccttttgtaccatgttaaaatttttgcttttgctttaactagagtggcatgcctttgaagggttttattcaagggactgaaatcagataggtgtgttagattattctgcctgtttaatgggggttgtctttggaagccagggataggacacactgtaattgattagaaaaaataatgagggccccatttaaggcagtaggcatggtgagggaagagttgggtgtgagagacagtaaggagtgtgctcttagagtgcggtgattcgtgggggagtgatggatgatggggagagaggggaactgaatgagcagtggtaccattcacagaggtaaggtggaatagatactaaattcagttttggccatcttgaattgtcttaattctgactcttcatatatatgagttaaactgcttcctgggagggagttttgagcttttgtttttctggttcatctccatggaaaaggtcaaaggttatgagttaggttcttgaattttctggagaaaaaaaaatcatctttattatctacactttgaatatctgttctcagccagcagcactagtactgacttgagtgctcactaatagcctcaatgttgaattaggggctgggtctccgctcctttacagagtacttgaaataattgaggtttcagtttgatagtgtaagggacttgttcaccacttggtatctgcatctgtgcctgtattcttttgggggtgtttattttttcttctctctcttttttttttttttgaaaaacgctctaactaaaaaaaaaaatttaaccttgtaacaatacataaccaagaagataaaagtccttcattaccattattaacaagttactaacaagttggtgcacatgctgtgcagtcaagtcacgtatgacacacacagcgtggcatggggcttgagcagaatcagggtctccttatactattctcaaaggtttttttgatcacaatatcattttggtcagcacgtaaatcaagctctctttttaatagttgcatagtgttttgttgtgtagatatatcatactttatttacatagtttcctgtgtaactgtttaccatctacattttccagttctctaaaccagtgctgtccagttctctaaaccaaagtctgccaccagcgtttctgtgatgacggacacgttctatatctgctgtgtcctgtgtggtagccattagtcacatgtagctgttgagcacttgaaatgtgagtactgcatctaagggactgaatttttaatttcatttaattaattttaacttaaatcgccacaggtggcttagtggctgccttattgggcagcatagctctaaactattccagagtcaagtgagatcattaggctacttccttagaccacatactttggtcttcatcaattatagtttaatgattttctttgatgttgaacttctgtaagcctctcaaagaaatatattttgttgccagactcctttaaaggtctatattttgctgcttgagttttgttccaacagagaatttcttcttccagatctatcagtgtacttccctctagcaagtaaagggtatctgtcgaccttactgtgcatctccttttgtcttggttgcctagaagcccaaagttaatttttatttttattatttttgagacagggtcttattctgttgcccaggctggagtgcagtgtcctgatcacagctcactgcagccttgaattccagggttcaagtgattccccaacctcagtctcccaagtacccaggactacaggaatgtgccaccacacccagataattttcgtatgttttatagagatggagtctcaccatgttgtccaggctggtcttgaattcctgggctcaaacgatcctcctgctttgtcatcccaaagtgctgggattacaggcctgagccaccacatcccaaagttaaatttttgattgaattatagcagttggttttttttgcctctcaccaccacccctatcaaacttcatcactttcttttccttatgagtttaaagatttcgttatgtgtatggttttttttaaataaagctcttcatattctttttgcaggtgcttagattttacatgaagtcttttggatctatcctaaaacttcactaaaaaatgattagcagcggccaggcacagtgacgcacgcctgtaatcccagcactttgggaggccgaggcaggtggatcttttgagctcaggagttcgagaccagcctggccaacatggcaaaaccgtctctattaaaatacagaaaattcgcctggcattattgtgcatacctttggtcccagctactcaggaggctgaggcaggagcatcgcttgagcccaggaggtggaagtggcagtgaagtgagatcatgccactgcactccggcctgggtaatagagcaaaactctatctcaaaaacaacaacaacaacaaaaatcaacagtatatacacactgcttccctcccacagtcatgcacacccacatatacatcttagtgagattctaaatattatcacatgtttgtgggaatcctgtttattacctcagaggaaactatgcatacttaagactctacttaagtactgttgtggttgaccacattttattccactgagttcagattgagttcctttatgtcctttgctgtgtcagtatcatgctttctttccttcagctttatttgggggaacatatgggaaatcttattttgtatgaatttaaaatacgttcttcaggatttcctagttccgtgcatgaccgcctccccaagataatcagtaactgctaaatggtgttaatatattttttcaccttcctagaatagcactgttaaggtatagaaccttgaataaaagtgtacatataatttttttaaagttttgctcttcctttttttctgccgagtttccccccctgggtatttttacatatatcggtacccttagtttttacatagatttcaaaattaagaattagaaagcaataagaatatgcagaaaagttattaataaacacttttgcctgcaaggaagtcgagtagaaccaggaaactactgatgtgctaaggataacacaccaaaccatctgtgttactaactcttggcaggaataaaatgacaaaacaagatcttgggagatgctcattaccaggtgcatgatcaaaaagataaatacattctcatgtaaaaaaattggcgtagtgcctttagcatccttggggcatgtgtgcgtgtgcatgtgggcaagtttagcatttggtgtagttaggaaattgggagaggaaaagggtagaagtagaggactttaacattgcttagagtcattgttattgcaaagtctggaagtgaactctaggaaactgcactggaattcaagtgtaatatgatgataaacatcaaatgactgtttgtagccgaggtgcaaggccaggctcttcaggaaagaatgaataggagaccttaaaataaacatctgtttttttattcagctaacagtggactttgaagaagattggggccatgttcagattttctttttcttccttgagaattgaagaaaaatgtcagctgaggattttttttatgctatttaacatgtcatttgtagtgtttcatgaaaagcagacagatatgtaaagctttttattccacttcaaattagaataataagttagatccagttttgaatttaaaagagaactttaacagatatgttttatgagtgagtttcatgattttgaataaaattttcacacacttaaactacagtggtttggccaggtacggtggccacaactgtactcccattgctttggtaggccaaggtgggaggatcatttgagcccaggagttcaagaccagcctgggcaacatagtgagaccccgtctctacaaaataaaataaattagctaggcatgggtacatgtctgtagtcccagctactcaggaggctgaggcaggaggataacttaagcccaggtgatcaaggctgcagtgagctatgatcatgccactgtactccagcctgggtgacagaacaagactctgtctcataaatacatacatacatacatacctacatacatactacagtggttcatttgaaagtaattctgtatgtcctgttcctaaatgttttaggaatatctggttttcaccaagcttgcatgttctgaatcctgcttaagttcaacgtttataaacctccattaggtatgtgaatttagttttcagcaaattattcctttggtttcccagaagcttccttcacattccagctcctcaagtaaatgttaaaagtttaacaaggaaaaggagtgaattgattttgtatatatttttgtttggtgaaatagcagagtgtaggcatggtcttttcagataagtttgctaaaaagtagtttcctgtcacctccctttgaaaagaactgaggtgtgccccatcctcaaacctaccatctttccaatttatttgtttattggagtagtaggtgggaataaatgtttcttagatttttctggcctcccttcctaagccagggtagctcctggcaaatagtccccagacaaaccttaactgggccgccttcctggaacctcattttatacccaaaatacaaaaaaataaaaatacaaaaataggaaaacacatgaagataaagtgctgcaaacacacgactttgcagatattaatcatacagagccaatcgcttatggtatagaaatagtctgaagtattcttttggcacagcattgcctgtgtgattttcgccagaaaggtttaactggatctgattatgagcagtgatcagcagaggactgtggggaacccctgcaaatcagggctctttctaagagctctggcctgagccttgagcagatgtccacatcctgaaagtcagtgaaggtgggggctcctacattaaaggaaactaaggagacataataacctccttaattcattttttttttttaaaaaacagctttttaaagacataatacacataccatgaagtttatccttttaaagtgtatagtcctaagccaggctctgtggtacccacccataatcccagctattcgggaggctgaggtgagaggatcgcttgagcccaggagtttgtgaccagcctgggtaacatagtgagaccccatctcaaataaaaaagaaaaaaaaaaaacatgaagtgtacagtccagagttgtgcagtggttgccactaattccatgacgttgtgtcacactaaccagaaaccccatgccagtttttcttccttctcctccctctcccagcccctgcaaccactcacctgctttctgtctatgcatttgccttttctggacattcgtgtacagtacgtggtctgttttttcttcagcatgtttcccggcccgtccatgttgtaccatgtctcagtactttattccttttgattgctgagtgacattccattgtgtggatattatcacatttgttcacccattcatcagtggatgaatgtcgttatccagtttttactaagtccagtgtttggacttagtgaagtagctagtctcttaaagatgagttctctggcaactttccccctcccttcatatggaccctgcttttcttgtttctttgtgtgtcctgtaatttttttgttggaagctggatgctttaaataacataatttaggaattatggaactcagtccctcccccaggtccccagggtttgtggttgtttgtttagtgactgtcctggactaattctataaaatctgatttctttctaacgtgtggccactgaagtctctgctcgttgccgaactgtcagctaatgaataaacagagatttccttcaatgcccggaaccagtcggtcgcccagcctctgccagagtgatcctcatgaatgcccctgctcaccattgctctctctattcaagccacactgggctggtctttttactgatccacaaacatgccaagcaattccaacctctaggcctttgtagttgtcaggtagtcttgagggtcactccctcctgccccttgggtccctgtccatcatctccccttcccctctattcttcattgccttctctccttcagtttccacagcaccagtctctgtctgtcatactctccactgcctctcccttgtttgtagtttcccctttctggaaggtaagctccttgagggtggggattgttctgtgttttgtttactgagtatctagagagaagggaaagtgcccgcctctttgttgaataagtgaatggggaggtaactctttgttgaataagtgaatggggaggtaactctttgttgaataagtgaatggggagggagcttaggcaacctgttcttatttaagaatgagggccagacgtggtgtctcactcctgtaatcccagcactttgggaggccgaggccagtggatcactatagctcaggagttcaagaccagcctgggcaacatggcgaaactacatctctacaaaagatacaaaaattagctgggcatggtggcacacacctgtagtcccagctacttgaagggctgaggtgggaggattgcttgaacctgggaggttgaggtggcggtgagctgagatcgcaccactgcactctagtctgggtgataaagtgagaccctgtttcaaaaaaacaaaaaaaatgaagaatgacgtgctaaaatgccagctggggccagacatggtggctcatgcctgtactcccagcactttgggaggccaaggcgggcggatcacctgaggccaggaatttgagaatagcctggccaacatggtgaaaccccgtctctactaaaaatacaaaaattagccaggcgtagtggcacacgcctgtaatcccagctacttggcaggctgaggcacaagaatccaggaggcagaggttgcagtgagccgagatcgcaccactgcactccaacctgggtgacagagcaagactctgcctcaaaaaaaaaaaaaaaaaaaaatgcagggtggtgttgtccactggtagttttcatgtggacccttcagctaatgactctacccagatatcaatatcttaaagtctgtcttctgggacctttcatttactccagagaagaatcccccagttttgttctgaggtgttaggggtttgggctggtagagtggacgcacagcagcataggcttgactttggcattccaggggctgggaaaaggaggcgagggtcccacagtttgatgtctagactgccattaattgtcctgactttagccccacagctcaagtcacctgtgcctggtggcatactccccacccaccccgcacatagggcagctttggttcccctcctccagagaattatcttctggtctctttaggcatggtggggatttgggtgttcatcagctccattgttccccctttattcgggcctgtgcctcatcctgtcgtcccccatgcttagagccttgaagttcttgtcccaaggattctgagagaggaatcttttctctttgctgttcacctctgtaagctctcatgtttacccggttaagtttcttaaactactgcatcttcttcttcagttctttttgtccttaaaggttaataccttttaaaatttatttactgtcattttaaaaaggcttgacagcgatgggggtaccactattaaccaaaagctctctgtgtttcttaacatcagttttaatttggtgtttaaatgtttgcttggggcgtcctgtctccgctagcccttgattgaaggcactctgtcatgcgtatctctactcatagtgtcatatagattgactattgcttgatgggctattagtgagatagtggcttaaggaatcttaacaatttttttttaacttggccttatttttcttgttatttcatttcagtccctaaattatcttttcaaatattaagtcatggcaggtaatagtttttcttttttaaaaataaatcttttaaaatgttgaaattaaattgcttctttgctaatctgatttttaagaacaaaacactacaagtagagtacatttaaatgactcataattactcacacaaatgcatgtaaacttggatatgcaattaggcagctcattatgctgcaaatgcaattacatgcttaaggtcatggccactccctctggctcacccagtgttctcttgggtttatgatcatttattaagcctcagctgtcagaatttgaaaatacatgctgctgctcctagtgaggcctttccaacaataatggaagaaaagctggaaaagaaaattttcttttgagtttatatgcagagttggttttcttaattggcaaaatcccattttcccacaggagatgcaggctaggtaattagaaaaattatcattaatcataatagtggtcagtgatatttatagtatatctatatttagtatatatttaccatatgtagctatgtatagtgtgtatatacattatagtacaactccatcatctcttatctgcaattctgaaatttaaaaagccttgaaagtttgtttataaccctgtggtgaaccctgactggacctgatttattaggacttcaacctatgtgaaataatgaatttctttgtaggtctgtgtttatcccaaatcactggtatgaatttgtgtaggttttgctgcagagatgttaatatggtttgatcatgggccactgacccagaccttactgaagtttttttgttatatacagcatacatactgtattacttttttaaaatgcaaaaagttatttgtttcaaactctggttccagttgtttctgttaaaaaaccagggcctcactgcagtgagctatggtcataccactgcactccagcctgggcaacagcaagatcctgtttcccaaaaagaatcatggcctcacagtaagggtaacagatttctggttagacctggatttaaattctaatagcgggctgggcactctggctcatgtctataatcccagcactttaggaggccgaggtgagcggatcacccgaggtcaggagttcaataccagcctggccaacgtggtgaaacactgtctctactaaaaatacaaaaattagctgggtgtggtagtgcatgcctgtagtcccagctactagggagtctgaggcaggagaatcacttgaacccgggaggcggaggttgcagtgagctgagatcgtggcactgcacttcagcctgggtgacagagtgagactccttctaaaaaaaaaaaaaattctaatgggggataaaaaccctctacctcttagagtgtgggttgctagtgctattattatttttattgttgttattgtttttattattgttccagttccagaactgatatttatatctatttttagagtgtcctgaaaacagttctataataaaataactagatacttgatatggttgttaggtggtaaaaaaaacttttatattcaaactccctgttgctgttagtaaatgtagttcttacctgcttgatttaatagtgtcattataacataaaagtttaaattgaatttctaggattgtaatagtataagatcactaaaaggtaaaaatgacaattcttttaactaaacatcttctgtgtaatcagtgaaatatattaattttatgtagcactacattctaactatttagtgtggcagttaagctttcctggttatgaaaccatagcctctcagttgttcagggccttgctcaagtgccccttgcaaagctatcttgatcggcctcagcagataaagggcttcctagaaccttttaaaaatttcttttttggcactaatcccattgtattgtacttgattgttttccacttacttatgtttgactttagcacttaacttttaccaaatgctcagttaactttttgaatgaatgaatgaagttgaagaaattaagaataatttagtccttccacataagtattgctgtatttgaaacaactctgttccttttgggtttcattctactatttttatagggtatactatacttggaacataataaatatggaatttaataaatatgtgatgaataaaaattgaattaaaatctatttcattacatttcatggtttcagttttattcctgaaattaaaataatttacttaggtcctttttccatgtgattctttttctttctcttcttgtcttctctggtcttctttctcttttttttttttttaacagggtcttattctgttgcccaggctggaatgcagtggcgtgatcatggctcaggtgatcctcccatctcagcctcaggaatagctgggaccacaggcacatgccaccatacctggttaattttttaatatttttaaaaaatatataaaaaatgtgtagagacaaggcctcactacattgcccaggcttgtaaaagaatatttctaggctgggcgctcttgaaattccagcactttgggaggccaagatgggcagatcacctgaggtcaggagttcaagaccagcctggccaacatggtgaaaccccgtctctactaaaaatacaaaaatttagctggttgtggtggtgagtgcctgtaatcccagctactcaggaggctgaggtatgagaatcgcttgaacctgggaggcagaggttgcagtgagcctaaatcacgccactgtactccagcctgggatacagatggagactgtgtctcaaagaaaaaaaataatatttctaaaaaaagataatttcaaatttaatggctgttctatgttatcaattattttcttatttgttccattaatagtacgttagataatgaaaggctttgtcatactcagtagcattataagtaagcagaaaaaaatgatggcatttgtattggtttagtagactttggttctttgtctataatattaatagtactttgttgtggttttaatcacccttgatctgttaaaaccatttatctggtaatcttcagtctttttttctgtctcagcacagctttgggatgtagcacagtgatttttctaaagtagagtgagggaaggagtatcttctttcagctccctaagagtatttattttatttttatttttattgttcttagagacagggtctcactctgttgcccaggctggagggcagtggcaccatcatagctcactgcagcctccaaatcctgggcttaagggatcctcctatctcaccctcctgggataatatttgggactacaggtacatgccatcatgcccagctaattttaacagtctgtttttgtttttgtttttgttttgttttgtttttttaagcagggaagcagggtctaattctgtcacccaggctggagtacagtgacacagtcttggctcactgcaacctccacctcccgggttcaagcgattctcatgcctcagcctcctgagtagctgggatacaggcatgcgccaccacgcctggctaatttttgtatttatagtagagatggggttccactgtgttggccaggctggtctcgaactcctgacctcaggcgatccgcccacctcagcctcccaaagtgctgggattacaggtgtgagccactgtgcctggccaacaatatgtatttttgtagagataggatctcactgtgttgcccaggctgccttgaactcctgggctcaggaagtcctcttgccttggccttccaaagtgctgagattaggcgtgagccattgcacctggcccctaagatttttagtgttcaccctttttcctccccacttgtagtgctttacaggaatacatgataattttgagttttataattaacatcttaaagacaaattgtaatcatagaagcagtgatcatcttgggcacatggcatgtattttcatgtcctttaaaattggttcttccgctcaagtagattggcacaagcagatactttgctgcatttgagttgtagccttcttgtagcatgttggtacataaagattcatattttatagaatcaagtatttccatttagattggttgatatgattatcattaaagttgctaagggagccacattatccctttctagcaatctgatgaatcagttttcaattttctacttttattactactgacctgtgagttgaagaaatatttgctgggcgcagtaccactgcctgtaattctgtctattctggaggctctcaagagtttcaagaccagcctaggcaacacagcaagaacctgtctctaaaaaaataaaaagaaaaaaagaaagtcttataaattgaccacagcatgggcaacatggtgtgactgaagcatagagtacagcaatgtaacagcaggacagaaaacctggaaagtttgaggtagtagtgatagtccatatatggctaaaaaggatgttttcctcaagttgtaaaatgtggaatttagaaagtaaattaatatatttcaaaggattagttgaggtttaacatattttatggctatgaaggcaataaagacattttacacattgacgctgtgatgtagctacatcagagagtgtgacgtgcctgtggttgagccctccttattggctaagctggccactgtttttgaaacttaatggtaggcctctgacgaaaggtctaatgtggataaaacctgcattttataccagtgtaaatcaataatttcaactttgttatggtggttttgatgttttttctctgaaaaggaactcaggaaatgtgattaataaggtcaactgctagatttaattttgtttttgatggaaatattttttcctagaaaatttaatggccatgaatctgattgcagagattatttaccataactagacctgtcccctgacaggcaatttaaaccacttccattaaaatctagataatcagaaagaatgttgtggaacattataaaagagggctatgtgaaagtcaattcacatctagactgttttagtattcctgccttcacctttgaaagtcagtgcacacagtataatctttttgttgtctttgaagcccatgtttatgattgatttaaaaaggtggaacaatttactttgaggttctttgggtaacagtgtacccttgtataggaatcaagatagatctaactttcaccagaagtattcatatacccagtagctttatggtgaggtatttgagtgtttttgtctgaataaggaatattagaccaatttagaaatacttttgccggagaggaccctttcagttttagtacttgatgcatatgaaattcatatgtgttttatacatgaatagatttatttatcacatagttattgagcacctactatttggcaggcactgttctaggtactaaaaattcagcagttaacaaaacagatgtctctcctcagaggacaatatcttggatattatattctaaaaaagcaataatagcatactttgatctcgtctagaaaagaaaagattgctgttttagggagtacaccattatctgatagagctttgcatttgcaggtttatgactcactggaagcagatacccctgtagttacaagggcctcaactctctcggcttcagaagatgcctgtgattttcctagcttgctcatgtgctccttccgacatgaagtcctttctttttttttgagtcagagtctcgctctgtcgcccaggctggagtgcagtggcgtgatcttggctcactgcaagctctgcctccaggattcatgccattctcctgcctcagcctcccgagtaactgggactacaggcatccgccaccgcgcctgatttttttttttttttttttttttgtatttttagtacagacagggtttcaccttgttagccaggatggtctcaatctcctgacctcgtgatcctcccgcctcggcctcccaaagtgctgggattacaggcgtgagccaccgcgcccggccatgaagtcctttcaaatagacttaattcggtgtcccagccttccctagtttttttttaagccatcttccccttggactcagtgcagtctgagttcattgcacacacattgtgtgtgtatgtgcgtgtgtgtggacatgcaagtgcacacatgtgcttcagctggattttaaacttcttcagggagattgtggtcagtgtctttaatttagcacagtgctttgtatgtggtagcatttagttgttgacttcaagctactgtcctaaaattgcttaaaaccatagcagttcttttaaaaagtgttctatatggaattttttaaaaatgccttgcatttcttgaaggtttgtcttttatggttggagtcaaaccacttagtatataaaaacctttacttctatttttaaaaattgtagattgcactaatatgaagtttctgtggaagactatatatgctcgagttattttcatgtttatgagtaccatagctgtgttgaggtgaagagaatcactctttctaatccggcaaaataatgtcactaaattattatggccatatctaacatttacttttctttttatttgaagagggtgttaacaggggctgtttttctttgttataactctcttccttctgcctttccttcttcagaaagtttaagctagatttaataatttccattatgatttctgggtttttttccagtatgcttgattgctactgaaataaacaggttaagtcgtcactggaagttccattttgcccgagtccagtgttctctcattggaatacctctagcttaagggaggatttcgctagcatgtcttctctgttgactgagccaaggtttcctttggcatacattgacctcagcgggtgtggcattttgttgggaaagatttgtatcaatagcaaaaatgtacaaagtgatcatagtattttatgaaagtaggtggattatattttttcatagttggattacaaacttaatgattcatattttattagttggttataattctgttcagccttttgttcctcagcctttcattgggataactcgtggagcctggtcacccatttagttttgaagaattatttatacagaaatttaaaaaatcaactaattatttttaaatggcaagtaaaaattatatgtatttgttgtgtaccgcatgatgttttgaaacatgtatatgttgtggaatggctaaattgagctaattaacatttgcatcacctcacgtagtacttaccattttttgtaatgagatcatttaaaatctactctcttagcgattttcaagaatacaatatattgccattaactatagtctagaattttagtttttaatgagttaaatgaattaaatgaagtggaccatgcagaatggaatgtaattgtcaagtaattagttgaaaaatcttaaaagaaagtaattttgggccgagtgtggtggctgagcctggcagattgcttgaactcaggagttcaagaccaacctgggcaacatggcaaaaccctatctctacaaaataataataataataataataataataataataaaaaatattgttttttaaaaaggtaatttttcttttagacttttgtttggcaaacttaaaaaatctagtgtaccaaataatgcttttgtagaattctagtagtattttgaaggaaggaggtgatacatgaatggatggatgttattataagtatctgaattatttatctgtactttgatagtgctaatataagaacattcattcatacttttgtaccttagactaagtgaggttgttttctcttacaagcctaaacatttaccactttgtttattctcttctgttatatacttgttcattatacatactgcatccatttgtcaatacttctgatagaaaaaaggatttagaaatcatgtttaacaaaatctggttataaataactgagacttggatggcgtggtaaactgtgcctttgctgaccttctcataaacaccaacaggttttgggtcctgctcctcggtggtgttccttcttagacaacttgaccgaagaattagaagagaatccagaaagcacagtctatgatgattataaatttgtcaccaagaaagaccttgaaaatttaggtaaaaaaaaaattgtgatgaaatattatgtaattacttcatttctactttttttttgagttttcaacatgagaattggctgagccatgtttacctcatctcccaaatcttccctttctgccaaatcagatattaaacatattataaattgtcagatttgtaacctttctccttagagaaaagttcaagtaaatttaacatgctgaagcttttttgtattttaaatgagaatttattttagcaaataatttcttttagcatactagctattatagaggaaaaaaattgtcacgaaagcagtgatttttttttcaccagtattatctgaagtataataaggttttgaaaatgtctcagagacggcaagtaaatgattcctgcctcccttttaggtttgattataaaagacccaatccaaaacttagaagtgatacattgaaacttcagatgtagaagaaccttaatagttactttatgtttgaaggtcacaagccaagaagtgtcttaaaagaacagcaaatacttatgagatagggcttactatgtgcagatagtatttttttttttttttttttttgagacagagtcttgctgtgtcacccaggctgcagtgcagtggcccaatcttgtctgattgcaacctccgcttcctaggctaaagtcattctcctacctcaacctcccgagtagctgggattacagatgtgcactgccatgcagcatggtaagacggggtttcaccatgttggccgggctggtcttgaactcctggcctcaggtgatccacccacctcagcctctcaaagtactgggattacaggtgcgagccaccacgcccagtctgtgcaggcagtattctaagcgttctacatgtaactcatttaatcttcacatccctatggattgggtactattatgattccattagataaggaaactgaggcaaaaaaaaaagataaatgtacgttgccagaagtttcagttgtagtaaacttgagagttgagctttaaatccaagagtccgtgccctttccccagccatcccagcccctgcaggacatgttgcgcctgcttgcctagccctcctctaggttagagtagatggtgctcatcttgttctgctgctgtcagagggctacagcagaagttactgagagtgggaaaacttagaggatccattctatacaaggcaaggcaacttagttgtctttggaacaaatagatgtgcaacaacagttgagtattaaaacagaatcatgttaccattagattaattaaacttcctttttaacccatatctcatagcacagttaatccaggcggaattactttctgtcagttactaccaaaaaagagctgaatttagccttttaaaaaatgacttgaatgaaataggaccttcttactgcagtgccttcttaagtgtctccaacgtagttttcataatatgctgtcacactcacctacattcttaaatcgaatgaaaaaaggtcattgttcttttatggattttttaaaaactactatgtttagtacattttgggttctttttcagtttctttactgggtttattttgggtgaaaaaagcagttatataagtttaggtatattttgttaaaaagtaattgtactgctcatttttaaaactatagaaatagatattcaacaaaatgacagtcatactagaaagcattttatgtatattactaatatcttttgatgtcaaatgagcttttatcatttccccataatatataaaaccttctaaatagaatatcttaagagtagaagtaagtaatgaacttcccttacttcctaagattatttttagcgcagcattagtatattgaagatttgcaagttctgactcttctggatatggccaacagcagatcttatagcttggtatttcccacagtgcgttctttggaaaattacgtctgtaaaaaggactgggtggatagcatagtggctgatattgtgggcactacaggtagactgatatgggtttacatcccacctttctcacttaatatctgcacaacttggccaattcacttcgcctctttaagccttggtttcctcatatgtaaaatgggaataatattggtcccaacccatggggttgcctggagaatgaatcagaaaatgcttggaaaatattcagcaccctgttattttaggagatttgtggcaaataagtttgggaaatgctaggttaagcacagttaaatcaatttctttacctcgcatacttcttagagcctttaataccatcatacattgtaaatctccaaacggaaggaaagtatgaaacatttcccaaacttacttgaccatggagcccttttttctcagaagatctcttgggactaatgatccatggagttaactgtaggaaatgctgctgcatccggttctcgggttaggattgtttcgctatgaaaagcgcttcacttggtttttatttatgacctgacttggattaattctgtgacattaataaaggaaacaaaaaattacttttgcaatcactggtatatgtattttataatgtagtggttaatcagacccttatcctgaggaagatttagagaatatacacgtgcagttgtatacattcacgtttcattaaggctcagccctcttttgttaggactccattgtgaaagtgcaaaccccatagttttattaacctaatgaattctatgacagtattttcctaatcaagttttagaattccgttatgagaatatcctaaatttaattttcttttttatattgttctataacatatactattttatactactgtatgattttgctcagtacttgattttcaggtctagatggatgtatatttctaaaatttggaaattagagtaatgctttccttagaaagacagtcacttataccaggggtccccaacccctgggccatggacccataccagttggtgggtggcctatgaggaaccaggccacacagcaggaggcgagtggtaagtgaccatgactgcctgagctccgcctcctggcagccgtggcatttgattctcataggagcgtgaaactagtgtgaactgcacatgcgagggatctaggttgtgggctccttgtgagaatctaatgcctgatgatctgagatggaatagtttcgtcctgaaaccgtccctccctgcatccgtggaaaaattgtcttctacaaaaccagtccctggtgccaaaaaggttggggaccactgacatatatcataaatgttctgcatgtgagtacatcacatgtggacttattttgaagatctcaatctttttctgtgtcaatatttggaattaataaataattcctgtgacatagagcattcttatgtgaccaccagcaccacaaattctaagtgtaacctattaaaactgggaaactctgtgaaagtattgtttgaggcagggttctcaaatgctgactggcagtggacttttcattagtccctgatgaggagtgcatatgtgatatgagtattaatatgcatgtatgtatgtttatatatggtggtaggaatttgtcagctgttctttcttggaagacggttctttctacgttgtgtttgtgagtgtcctttgtctttgcaaatggtcgatgacaatgtttctcctgtctcccttctcctcatttcaatttggcaacttactgttgatccccagtattattttctaaattgaacttgtttgtggaaataaaaaatctgaggaccactcagagggcataagggaaccctctttgtcttagttcataaggactttctcatcatttttgtgtgtagtattattacatttaaaataaggatgatattgctgaagtagattaaatgttctctatagatatcaaagaagattagtaattctaatccttaaatttttagtctgaagtgaaatcttactataatcaaattgttgcccaagaaaaactgttgaatgttaatgaagattgcataaggacctgctgtcttctgtttgacctttcccagggctcacccacctcattggatctcctttcctccgggcatatatgcatgggtttttcatggatataagactctatcacaaggtaaacagaaaattacagttattatgtttcaggtaactaatgcgcagtctatggccatttcctcactactcgcactttcataaatcatacataggatttgtaggggatctgcctgttctttggcataactgtcgtggtgtatatgaaaatgatattaccaaataccattcttttattttaaaaacttttttcattttgaaaaggtgaaactgatggtaaatccatttgcttatgaagaatataggaaagataaaatacgacagaaaatagaagaaacacgtgcacagagagtccagttaaaggtaaatattatacttaccattgaatttatcagagaagagtacttaatttccattttgtgtattattccaaagaaatctgccattcttttcttgattttccatctttaatttgcatcttttactgatatttttggtatagtttgtttgtcatcagtgtgtcatgtttgtcatgagggtgcaaaactctttacaattttcgcattatgacctctgcggtaattgtactgtgggacataatgctagaatgattgatattgtcacctccactagaaacctgatagcatttttaaatgggttttccatttttggagtatccgggctttgctaatccctattccttactgacctttggccgtatcttaggctctgtttggatcatgggaaatggtcgacagtcgtaaactgcactcgctgtctgagtacatagaatttaatgtaaagaatgattaacttggtattggagaactgaaaagacagaactgctaaaggatggaggagagaggtaaactgcaggaagcagccaccaactcagagctgcggaacagcctggggaataggaagaggaggccccgtggagctggacccaggcctctgaggaggggccacaggccggttccagggcccttgaggcataatagcaaggatgttcctgggagcgttggaaactgcaaactggaatccaccactgctgtggaaccagctgttgtttccaggacaaagagttgctgttgtgtgatgccagtgtagacagagaagggcaggccctgctcctgcacctgccttgcagtctgtctgcagccgcccctgttggttcatttcaaccaccaaatgataccaatgtgtataactgaatgttggtatacgtacatactctgtcactataaaagactagtgactgttttctgcatttaccctcagtacttttttgtttttccagactgttaaaagatttctggtgtatttttgagacaggatcttgctttgttgcccatggtggagtacagtggcatgatcagagctcactgcagcctcgacctgagctcaagtgatcttcccacctcagcctcccaagtagctagggactataggcgcacactaccacactcaactaattttttgtagttttagtagagacagaattttgccgtgttgcccaggctggtctttaacttcagggctaaagtgagcctcccatcggcttcccaaagtgctgggattacagtcatgagccattgcgctgcctctcagtgcactggaaagaggctctcagtgccctgggaagagaaatgagggcgagttccctagcagtaagctggggttgccgtttttttgccatgtggcccacctggtatcatcacctgtctacatttcctactatgaggataatgaaatttttaaaatacgaattagttggctgggcgtggtggctcatgcctgtaatcccagcactttgggaaggcccaggcaggcggatcacgaggtcaggagatcgagactgtcctggctgacacagtgaaaccccgtctctactaaaaatacaaaaaattagccggatgttgtggcgggtgcctgtggtcccagctactcgggaggctgagacaggagaatggcatgaacccgggaggcggaggttgcagtgagctgagattgcgcccctgcactccatcctgggtgacagagcgagactccatctcaaaaaaaaaataataaaataagaattagttatctcctatttatgaaattatacttacacaactgttcacctttaagctaatatgtaaatatgttagcttttaaaataaaataaaataccagcttttattttctctctagaaattgccaaaagttaacaaagagctggcacttaaattaattgaggaagaagaggagaagcagaaatctacatggaaaaagaaagttaaggtaaggtgaaaaagtatcggcaaattgtttctgcgttttgttgatagtaacttacatcttttttattgtttctttttactttaaaaatacatgtaggactttttctttcctgcgtataagattagtatatgcttaagatgggaagtctggaaaatagaaaagaatatcaagaagaaagctatccttacgattcttataccagagaaaggcatcattaatatttcagtgaattttcttcctgtcttgtttcaaaattagaaactacaatagcaagagtcttgtatgtgtaaaatgtttatcctgattctttaaaataacacaggtggtttcccattttgttaaaaattctttgtaaatatttttaatggctacatattctgttttatgaagtgattataatttactcaatccttctattgttaaacgtttagattattgtttttctttgttcataactccagaagtaactgatttttatttagacttggtgttcttacgagtatgcaggctgaagtgtaacttccacctgctttcctttattaatgtgaaaatagacaaagatcagtcataagataaataaaagttagcactttgtttagttggtattgtccagaggtgagatttttctagtgttttcagatgtatgaaggtacctgggtccttgccaatcttgttttctctgcttagatgaggcaggcagatagccaagcttggttatgtgctggaatgagttggaaagaactgatctctgcgacagcctgcagaacctaatgagtaaggagctgaccttgtagttttgggccagctgtgtggtgccctcaggaggttctttttttttttaagcttattctttctctgtcctctggtttttaaccaggtacatgcatctaagatgggtgagctccttttgtcttcatttctgttcatgctcttcaatacccagggactgcaactgaagggtcttgttcctagctcctggcacactgcttatgtaatcttgggcgattgctcatcttcatggggtcacagctttttcatctgtaacatgcaaggaccggatatgggcattcttagagctgtgctttccaaatggattcagactcaagactcccccttgctgtctcctgcttccttagtctttccctgcatcccctcatcctcgtttattacattcctttagtatattgtttaaattttaatttctggaagcctctcaagtaaatagaggacttttaggtttccattttcatgacatgaatagtatgccaatgttgaaataattcctcaaacttattaatatttgaatttatgtctgtgtgtaatagctctgcaccttcctaagttacaccaatgtgtataaatgaatatatatatctttaagtatttagaatacaagtctttgctgctgtgttgactctctcctcagagtattcacactgatcttcttgttagctaagcctaagcatgattagggaggtaacttttctgctttgtaatgtcattttacagtaaaagctaaatggaagtgatctttggatgtacatgccatgccctaaggcttcagtagatagagagtagagctaacttagactgtagatgtttgcattcctatctgtgttttatgccagagtctttatcatctgatagaggcaagaatacttaagttacaatttaattttgctactttgtgcagcatgctataccagagcctgtttataaggccctgtgattatctagatgcagaagtgcccttcccttcccccccatttctttgtagacctttgctgaggttgagggcagccagagaagatttagaataccccatagtgcaggatggtggaaatgacttcacaagttgaacacatgcagagcaatcctcatggtcaggagggaaaattagcattgttccatgcctttaaacatttttgacaaaacattaaaaactctcttactgtccattataaattggaaaactaggatcttttcattatattgtaatttaagacattaggaataaagcctaattgagtattttattttctttgttttcttttatttcttttgtcaatagtacttggaacagtgcttacttttttctcctcctaaacttttgatacggagccagcatttttctttgcctcagcaaattgtcatactcactttctaagtttggataagcttccgatgtttcatcctttgctcttttgacgttatgaattgtctctgagagttcctttcatgtaaagttttttgccagtgtcacttccactgggacacttttcttcttcttgtcacaactgttttcctcatttgttttcagaggttcaccattacgtggtcccctcactacagacttagagtgccagccagtgacagtagccacattccctgtattcccacagccagctctttcttctgtaactccctttaaatttgattcacatttttgttgttgcagttttatcttgttgattagttctctgtaaattattcttttttgtaaatgtcacacgagtttgtcttcggtatctaaagaagcaatgcaacagttatacacgcgtcctgtctgcaggaactgaacaggaaattcacggtgcatcacaccgcctgatgcagtgtccggtcactgacaggctttgagaaaagcaacccattatttacgtagggatttgtggactaaagagctcgctgtggagttatactttatgaacatactcagttgatgaacagagataactgaaatttgaaccgtcttgttggggcacctggtattctttaactgcattccttagctactccttccttttggcaccgtgcgaatcaagaacttgcctttctgttatctccagtcacatctacgttccgttgatgttcactcattttgttgctacatattctctaattaactatcaggatggcatttgattattttaaaacctattggtgggtcaccctgtaaagatttaccaagctgtgtaccattttacttccagtgaaaaggaggaagaaccttagaaattcctatcttcttccatcaaacagcagtttctcttcagctcttcatagctggaaatgtgatctttgtagccatatcacgtgataacagaattcttccaaagagtactatttgtaaaatgtgcccctaatcttcttgttggtgacttcctagcccaaatcagacctattatcagagctcagtttcattccagaaatatttatatatggtcttttgaaaatctgaggctgtgcttggaaaaagtttgtataatttgttgttgaacagtttcatcttatgtaaagtgaagatcgtagaaatcactcatgaattaaggaaagaatccttcattataatttaaaagactacttgaaagaattgctaagtctcatcagcagatcattagtctcgcctttgaactcagctcctcaaaagcttgagaactttactagctgtgatacctcctgatttgaaagtaggtatcttgcaataccaatttgaaaggtatgttttgccttgtctgcagctgaaatttattggagacagtgaaatgtgttcccaaatattgctgccactgagaacacaaaaatcgaataagatgtttactgtatggttgatattgaacctaaaatgggaagtggcccaccacataatgtcaatcagtattatatggacattatccaaactcagaaattttggttgcattaattctagttaacaattaaggccgagtgcagtggctcacgcctgtattcccaatactttgggtggctgaggcaggaagattacttgagcccaggagttggagtctgcagtgagccatgatcacaccactgtactgcagcctgggctacagggcaagacagcatctctttaaaaaaaaaaatgaatgaatgtatttattctttcaacaaatatgtattgaatttccagtatgcacaaacagctttgagaggcatgggcatctgtgatctgtttgatttgtgagggtttgagttttggttagagctatttttcctataggtatcattttttgtatgttagtcttttttgtcagtttcttgctgtggccttaaagtctctgatgaatgtacttttctttcattctgcagcagctcaggcaggactgtgcatgagatctctaggccaggggtctccaacccccaggccatggtactggtctggggccttttaggaatcaggccgcacaccaggaggtgaacctcaagcttcatctgtatttacagccactccccattgctcacattactgcctgagccccacctcctgtcaggtcagtggccacattagattctcataggagcatgaaccctattgtgaactgcgcatgcgagggatctaggttgcgagctccttatgagaatctaatgcctgatgatctgtcactgtctctcattagcccccgatgggacattctagttgcaggaaaacaagctcaaggctcccgctgattttatattatggcgagttgtataattatttcattattattacagtgtaataataatagaaataaagtgcacaataaatgtaatgcgcttgaatcatcccaaaactccctcgcgcccgccccccgccccccaccaccatctgtggaaaacttgtcttccgaaactagtccctggtgccaaaaaggttgaggatcactgttctaggctatgtgtattctgtggttaggaacccatggaagagatattttagcagtttcaggaattactaaataccactgagaacttatattaaagtaatacctcatctctctagggaatacaattaggtacagatactttgggttggatcaggtcagttttaacatccaaaatattatttttaaagcttttttagtatcaattaaaatttttgttttttttaaattacagttatacatgcatagttttaaaaactaaacatttcagtctgggcacagtgcctaacacaaacattatgggctcacacctgtaatcccagcacttcgggaggccaaggcaggcagatcacttgaggccaggagtttgagaccactctggccaacacagtgaaaccccatttctactaaaaatagaaaaactagttgggtgtggtggtgcgtacctgtaatcccagctacttgggaggctgaggcaggagaattgcttgaacctgggaggcagaggttgcagtgagccaagatcacgccattgcactctagcctgggcaacagagcaagactccatctcaaaaaacaaacaaacaaacaaaaacaaaacaaaacaaaaaaacatttctgtaatcccatcattttgggaggccaaggcagggaggatcacttgagcccaggagttcaagaccagcctgggcaacatggtgaaaccgcatctctacaaaacattagctgggtgtagtggtgcatgcctgtggtcccagctactcaggaggctgaggtgggaggatctccctgcaaggccgcagttagccatggttgtgccactgcactccagcccagtaacagagtgagactctgtcaaaaacaaaaacaaaaaaaacctaaacatttctccaaggtttgttaggaatgtaggccatcccattgtctgccccttttcctccctctgccttcctccattttcacctcttctcagacaaccacttttgccttttttgctgattattttggtataaatctctctctctctctctctctctctctctctctctgccccctccccctccctccctcttgcctgtagtcctacctcttaactttttagtgttaggcattatcttttgataactttcctttccaaggaagctatattgtgattttgattaagttggtattcagcattacattgttgtacttttgttttttgagatagagcctgttacccaggctggagtacagtggcagaatcatagcttactgcagcctcagtctctcgggcttaagtgatcctctcacctcagcctctcaagtagctgggattacaggtgcacaccacacccagctaatatatatgtatgtatatattttagtagagctgaggtctcactgtgttgtccgggctggtctccaactcctgagctcaagagatcctcccacctcagcctcccaaagtgttgggattacaggcacgagccaccatgcctggcctacgtaagtgctatttccagccgagtcagtagtaatctgtgactgcatttcttgttcaatctttgtgtcctttgaagttaataattgtctctcttgctcgttttctatgtagttatcactaatcaacacccaattctatgtcagttctctaagtcttattttgaggtgtttagataggttagacttatgcttatttaccttcctgaagaagttgcttctagaattttctgccccattccattctagcctggtcaccttctaatcccgggacctccctttaccattatcctggggattcacttcacctcagcccatgttggacagagaattacaagaaccttcagtttcctgaaggaatatagtttccaacctaggcaagcagtcagtcaatgtgagggtatggtagatattttcagacatgcaagttctcaacaacaaccaattccccttaaatgctgcttttcctcgggaagttgctaggggagttgtttctctaaaataacagtgtaagcccaggaagaggaagcgtcctgggaaacctgacacgaagcgactgtactgtgctgcaagcccatctcagtctagaagttcggtcttcagtgctggggaattttcttgaaagaaaatttcaattagtttttcctgccatgatccatagttattttttggcagtgaggaataagagagttaaaaaactgaatgaaaactctaggtggggacagggtccctcagtcagtgtgcagtgacttggccacactgtttggggaaggacactgcacatgtcattgtctcttaggtctttctcttggctggtcaggtcctcctgcttgggggggtaaaggcctggctaccagcattcctagaactgaccactgtaggtcacaagaggttggaggggtccagagagcacctcacccccatgtgccagccttgccctcccctccttgtggccagcacacctctcttgctcttgcagtgccagcctcagccaagcaacttctccgtgggaaagggctggggccaggctttccagagctggggtgtgatttttaaataggctttctttctggcttccaaatttttattacccctatttcctttcctttttttcttaagggtttatgccctttttataaagctccttttctgttgttctagtgaagttttaggagagattagaagatactagtgttcaagccaccatctttactcagaagtctgtaccagcctaacttcataggtatcatagcattgaaagaactaatttgattggccggggtgcagtggctcacgcctgtaatcccagcactttgggaggccgaggcaggcgaatcaccaggtcagaagtttgagaccagcctgaccaagtggtgaaaccccgtctctactaaaaacacaaaaattagccggccgtggtggcgcgtgcctgtaatcccagctactccaggaggctgaggcaggagaatcgcttgaacccgggaggcagaggttgcagtgagccgagatcacaccactgcactccagcctgcgtgacagagcaagaccccatctcaaaagaaaaaaaagaaaaaaaaaaaaactaatttgtttcaaatggcaatcattcttcatatatgttactatgttggaacaaaataataataggcgtcccactcaggtagacagataccattcttccaggtaggactgtggtatgaatagtactttaatgttttctatattttaatggtaaagttgagcatgtgtagacgggtatttataggacggatcactagccagacacttgtaagctcctatagaacattaatagctataccttatcctacttttttccttaagacagctgtgaaaacaaacagactaggaaaaaaccctgagggaaatatttttacaagctgggtcagaagaggttttattttatagttgttcatccaaagcatacttgtctttaggcaatgcaattgatttgttttaaattaagaaaaaaatcttaataccagcaacatatgtagtctttgtaacattttctctatttattaaatatgattattactttaataaatatagtaagatgaaaagtaaatatttgcccttgggtttttttaacctgaaaatgtgtaataggcacatagttattcatttgaaattatctttcacactatcatctatccgatatctacagataactccaaaatttacatcatagccccctcccttctcctgagacatggcgcatcgttcccagacacctagtggtgtccgtctgaatcctggtgctcttctccctgtgccacaggcataggcagccctaaatggagcgtgatttcttcccctttactccacccctgcgttttttcctaatgctctccagtgatggattctaactcagtgtcgccagctttctggttgcttaagctacatgtttgagagaagtttctaaccctgtttttaattcttaaccctcccatctccatagctggatctgtcaattctaatttagaactgtatctcgtaattattctttcttaaaaactgtctgttcccattgccctaattcaggccctgtctctcttgccagtttcttaaaatggcttcttagtcttctcatgatgctaacttcttactcagcagtccgtcagacatcatgctgctgcagacttttgaagcacaattttgggttggtttgtttgtttgtttgtttgtttgtgacaaggtctctctgttacgcaggctggagtacatggtgtgatctcaactcactgcagccctgacttcccaggctcaagcgatcctcctacctcagccttccaagtagctgggactacaggcatgcaccaccacgcctgactaattttttatattttgtatagacagcgtctcaccatgttgcccaggctggtcttgaacttctggcctcaagcagtcctcccacctcagcctcccaaagtgctgagattgcaggcatgaaccaccacctggccagttctgtcatctgggagtcttgaagcacacttctgttgatcatccatcttctccttcctccctccttccctgtctccctccttcgtttctcttcctttttctcttcctcttcttcctccccctcctcctcttcgctagtggtttccccttatatcttcaaaataacagtcatggtatttaaaatcctttacagtatgacccaatcaaaaaattgttttgaaattgcatcattcttatgtcgccagactattcaccactcccatcggctggaaatgctgtttcttcagatttctacttgttgaaacctactcatctttcaagccccctccctgatgctgcaccccccagggcccctcctggggtgtcttttgttgagattcctttttctgtcctctcctgtggcactttcagcactaccgagcagccctcagaagaggcctagtagcacgtgtttgcagtgttttttcttccttactagtttaggatcaggaactcgatcttacctttctttttcccttcgtcgtaagtctttcttggaaatgatgtttaatcagggaaacttgctgcatttaatatcttagaattttaggtaagggtttatctgtttttaggtacatacaaataataaacaggccaagttccttaatatcttatgatttactaaacttttgtataggtctgtcacacaaataatattcagaactcaactgcctgcaatcttgtttactctcaacagtggagaaatagtaaagtagtctgttcagcagagtcagagtccatcacaaacaggtcagctttttccagcagtgttcagggctgtttactctgattgacaaacaattctgagtaagccgtttcatctggcttccaagcctgtagcagagaaggaacaataagacagtcctaaatgtgtaagattctctgtcatctacttaagtgaacaggtaagtttacagtacagtttagaaaactttccattgaaaatggtacaaataaaaaggaatttagtgtcagtcctgagctatctaaatgggtctcagtagccaaagtttttgtatctgaaggatacacaatatcctttgacaacaattagttgacctgagggggaatattgatgaaacaaccctgtaggggatggatcagctggaatcggtaaactgacatcaccagcttcctgcatcccaccatgtgagttactgactttgtatacctcctctcccagttttggaatctgaagttgaaagaattgcttattttaagtcagtgtagtaactaagctttatttaaaagccctgttttcagtggctcatgcctgtaatcccagtactatgggaggccaaggcacgagaaattgcttgagcccaagaattcaagaccatcctgggcaacatagtgagacccatctctacaaaaaataaaaaattagccgggtgcggtggtgcacctgtggtcccagctacttgggagcctgactgaggtgggaggatcacttgagcccaggaggttggggctgcagtgagctgtgattgtgccactgcactccagcctggagtgagaccgtatctctaaaaaataataaaagccactttttaaaaacctagtatcttcttgaaaggtgttttttttgcattaaaatgttaattgaagaaattctttctaatctgttaagcataaagttagccaaaagggtcattcttggctcattgtgtgtaatggccaagtggtgtagagcatctgcaaagtagattaatagaggttgttttggtggtggcagctaaaacctaggggcacgttgaaagtcctggaagaaatttcataatgagttaataatgtatgcctcatgccgcttattaacttataatagaatcagtgttttaaaaccatgtttctggtcaaattttagtcagatattaacttaaatttttacatactttttcctccttgtagagtcttcctaatattctcaccgatgatcgatttaaagttatgtttgagaaccctgacttccaagtagatgaagagagtgaagaatttaggcttctgaatccacttgtttcaaaaattagtgaaaaaaggaagaagaaactaagactcttagagcaacaagaacttcgtgaaaaagtaatgtactccttatcagttagaatttgctactgtttctttaatgtaatgttttctttgtaagttagaagagtctttgattatacttgagatgtaattaattccatattaagtgtttgacattgggcttaggagtattatcttatttaattaaaggcatttctcctgatgcatgcagtagagcagctgttaggcactcattaatgggccagtgctgcttcagagaaaccaaggggtctgtgtttgactgggggaaaggagttgctgcttactatttttattctcaggaagaggaggaagagccggaaggaaaaccaagtgatgcagaaagttcggagagttcagatgatgaaaaagcctgggttgaagaggtcaggaagcaacgcagactcctccagcaggaggaaaaagtgaagcggcaggaacgactcaaggaggaccagcagacagtcctaaagccccagttttatgagatcaaagcaggagaagaatttagaagcttcaaagattctgccacaaagcagaaactgatgaagtgagtagcactgcctgagcgcacagttgacatgtaaccaagcccttgcttttcctctctggcacattgccctaaagatgacatttctgtctttggatgatggaggtgcagagggtggaggggacgagggaagcaggggaggtaaggccgtgcaggaggtgatgtgagggaagcacccaggaggcctgaggggagcgtcgctattgaagtacattggtctctaggggatttacttatttgtcacaactttttgaggtatagtttacatgcagtaaaatacagggtagagagagccttatgagtatcagtggaacacttttaagctgcagaagccacacactttccttgtccttgttttttccccatggggttccctcacctacaaatacttactctgtgccctacagatcagtggtttgaagccttttggacagtggttgctaggagatgacaacttttctgcttcttcacaaagttattttaaaaaattagaacctcggttatgtttaccccatctcactttacctggttattgaaaaggttacttggaaaatttgccagaaattttaagtctttttcaggaaaattgagagatcgaaaagagtagtattctagaataggcaaatatgtagaaagaggcagaaagtagaatggtggttgccgagtgtttcatgggtacagagtttcaggttggattatgaaaatgttctggaaatagttggtagtggtggttgtacaacagtgtgaatgtacttaatgctgctgaactgtctacttaaaaatggttaaaatggtaagttttatgttataaatatttaccacccttccaaaaaaattgaccttccccaaaaaaggtagttttatttgaataattttcagttgtcaggagtctgagtcaggaacaagctaggtgtcaagcccaagttgtatgtaaactctaaattatgcaagtctctgctttgagaattcctaggcaaagtattgatgcacaagattggaatatgatagacggtcacaggagatgtcttaaaagaatagtggaatgtctggggagccaagggagcagtcttgaggtggagcaagaggagtgggcagaatagacaaggtgttaggctggggtcagtacatttctgtaccttgtacttctccagctcccagctctccgtgcaggagaaggtgttttctccgaagtgggaggaggaaaagggtggggaggacatcagtgaacaggtggaattgtttctggggttgagatatgttttattcatctttatttcaccagcttctagcaaatatctgcaacaccagatgtagtgaatccttgaatttagaattcagaagcacctcaaaattctggttctgatgaactaactaaagatatgtccatgaataaagaagctagtagagttgacccttgaacaactcgagggctaggagtgccaaccccctgcaaagtaaaaaatgtgcatttaggccgggcacggtggctcacgcctgtaatcctagcactttgggaggccaaggggggggcagatcatgaggtcaggagatggagaccatcctggccaacatggtgaaaccccgtctctactaaaaatataaaacttagctgggtgtggcggcacgtgcctgtagtcccagctactcaggaggctgaggcaggagaattgcttggacccgggaggcagaggttgcagtgagctgagatcacgccactgcactccagtctggcaacagaactagactccatctcaaaaaaaaaaaaaatatatatatatatatgtgtatatatatatatgtatgtatatatatatgtatatatatgtatatatatatgtgtatatatatgtgtatatatatgtgtatatatatgtgtatatatgtgtatatatgtatatatatgtgtatatatgtatatatatgtatatatatgtatatatatgtgtatatatatgtatatatatgtatatatatatgtatatatatatgtatatatatatacatttaactttttgtgttatttattttcactagaaagtctagacctaacacatacaacttttgatttcctgaaaacttcattttttttttaaaccttcttggtgactgagaacctagaatatccccaaaaactttactactaatagcctactggtaaccagaatttttaacagtcaggggtcaattaccacatattttgtatgttctatgtattatatactgtactcatacaataagataagctggagaaaagcaaatgttattaagaaaatcataaggaaaggaaaatatatttattcattaggtaggagaggatcattgtaaaggtcttcatccttgttgtcttcatgttgagtggtctgaagaggaagaagaggagggattggtcttcctgtctcggaaggcagagtcagaagaggaggaagtggaagggaggcaggggaggcgagtaatggtgttaacttttattggaaaaactgcgtgtaagtggagcagtgcagttcaaacccatgtcattcaagggccaactataatgttcttggtatcttttgaaggtgttttctttactgaccaacctcactttttaaaataaccactttcttgagatataatttatgtaacatacaattcatctgcttaaagcatgcagttcactggttgttagtaatgtaacatacaattcatctgcttaaagcatgcagttcactggttgttagtaatgtagcatacaattcatctgcttaaagcatgcagttcactggttgttagtaatgtaacatacaattcatctgcttaaagcatgcagttcactggtgtttagtatattcacagagttctggaactatcaccttaattttagaacattgtcatcaccccaaaaagaaaccccacgccttatgggcagtcaccccacatttaccctaccccatctcccatcctgaggcagccactagtttacttttctgtctctatcgatttgcctattctgacatctcatgtaaagggaactgtataatgtgtggccctttgtggctggcctctttcccttagcacagtgtctttaatgttcatccgtgttgtagcatctatcggtgtagtcagccctctgtatccaagggttcctcatccataaattcaaccaatatgggctgaaaatattcagaaaaaatttgtaactgtactgaacgtgtacagacttttttcttgactttattccctaaacaatagtataacaactatgcatgtagcatttacattgtattaggtattataagtaatctacagataatttaacatataggagagggtgtgcacaggttatatggaaataaccacaccattttatacaacttgagcatccatggattttagtatccaagggaggtcctggaaccaattccccagcggataccaagggacaactccactccatttgtttttattaccaagtaatattccagtgtatgtatagaccagtttatatcccttcgtcagttaatggacatctgggtagtttccactttttggctattatgaataatgctgctatgaacattggtttatacagttttacatgtgttttgcatatgttttcatctatgtgcaagaattggaagaaattgctggtcatatagtaactctatgtttagccttttcagaaaccggcaaacttgtccacaggctgtgccattttacattctccagcagcgtgtgcagcctcactttttatacagctgttatgtgtaggtgttttactgggagtcctgcttggtttgtgctgttctggttctgtggagtaagtttatttgttgagtatatgctgtttttgtcttgctctatttactgctttatctctggctcttgaataagtacttagaatagagtgggcacttgagaaatacttgctgaaactgtgaatcttttttgccatgacaacacatcaggcaactcagaagttactccttcaagatctgctgagaaaggactccttttccccatagccattgaccaggaaaatctgggagcagttgttttgagtgtaaccacagcaacaggaggctgtgatttgggggtaggcggtctgactaatctctctaacattcttccttttgcctgggggctgtagtaggatatggaggtataaaacaaagaggataaaaatttgtatctaagaataacccatagcgaggtgaataaactgcagttaaacattctaagttaaatatcaccaagttaaacattcttactaagttaaatataaccaagttaaacattcttactaagttaaatatcaccaagttaaacattcttactaagttaaatatcactaagttaaacatcctttttgagaactatataagtgataatatttacatgagtatttggtgaagcattaaaccacgatccttcagagaactaaagtgactctgtatgtttattctgcaagttaccgcaagccagtcaacaagagacaacatcagattgaatgtgttatatttaaatgttcacttggacttgcctagctttaaaactgtttctataaagggaaaggtggatcgtgaatggtagctggagacttgagtgagctgtctgcgttgcttggtgtggtcatatggctttagataaacacgtgtgtctgttgacacatatttttatgccttacagtgggctaactttgtttgtgagtctgttcatccacttatcagcctctccaccacccattcattcatcaagcatttatcaactgctcagtgcgagcataccagcattctagacccaggggatgggaagaacgacatggcctgcgtacctgaagcgctcatgggaaaggagcataagaaggaaggagctgaatttggggagccttgaaatcatatggaaactggttgtggaaagatgcagagtggagcattcagggctggtgggaaagatagcattcctggcagaggcacggtgcagccacaggcaggccatgcgaagggttgggggtgccttcctacagccagagcatggggtgcctgaaggggtagccgagcaagcactggaaagccacgatcttacagcttagatgaatgggatccaatctattccaacccctcccctagtgttgtaaatacttttgtaataaaagcagtgcatgtttgttgtagcaaataaaaacataggcataaaaagtccctattcccagaaacccattagcagaatatctccattttagaaagacaatgtgcggagaacctggacacccagagaccagctctcaaaccattagaatcatcccagttagaagggccacaggcctgaacgatggggtggagaggagcagacagaccagaagactaagagtgagaaagaaaaaggagcacaaactccaccatcagttcctaataatatcaaaggagaagggaatagtcagggatgacgtagagatgtctagtaatgttgccattgaggtaaaaaatacagaatgcaaaataggtttaaggctaaaagtaatgagctgggttttgtgcacattaaataaaggagcccatgcgtcttctgtgtcacattcagtaaaccaatggcagtgtccatcgggcccaggaagaggaggctggagatgtcagtttgagagataccagcctttattgtgtggtcaagatcacgaatgaaaagagatttagcgtcattgtataaagtaagattagggctaagaatggaagcttggggaaaaacaaatattttacttgaatctgtgataaaatccataccatacacctctctagagaaaaatacaaatgcctgtgatgtatttacatagaattttagagaattcacagatgtactgattgcctagaactaaaaattctgttagaaagcagacagaggagaagatggacagtaaagatactggagttgtcaacaagctgagaggaaaactggaaagggccaaacctggagcgtgtctcagggaagggagtggtcctgacacccatcggagtagagaggcccaggaatgaaggctgggaaaaggccagtatgcggatggcctcactggcactcgtttctcagtcctgccaagtggccaactgcaatagagacacaagtgactgggagatagaaaacacagtaaacagttagtgtcggtgagtctttcaagaagtttggtagtgaaagaaagggatgaaagccaataacttgatggaaagcggtttatagacttgagagatgtgatttgttagtaggcagagaagactcagccacagaaagtgggtagtaaggaatggagagaattgagtcagttgataaagtagcatctggtaaggaactgggtggcagtgggcccgagtaccaggtaaggagagcctcagaaaagacaaggtatgcatcctcagagacatggaggaaagaagtccagatgcgtgaacataggggacatcattctggttagaggtagaaagattgggaaggccatgcttgttggcctcaggaatctgggcacatcagccttttctggtatctggagcagccatgacctgcaaggtataggagtggagctgtgtgtgttggtgaacagtggagaaagagagtccttagaatgaaaactctccacgtttcagtagatggggataacttctctccttgggtagtcaatattagctgccaggcagcctttcagttccatttatgaaagcattctttgaagtacctgccctgtggtaggtcctagaaattcaaagatgtttaagacagtccctgcctttggggagctcatcttcttcaccgggtagcttggtagctttgggtgagctttttatcgtgtctgcaacattatccactttgtgaattaatatggcatgtttttactcttcagctcacattcctctgatagtggataagagctgaggtaatgcagctttgttttaatataagcatttaaaaatctaatctggaaagtaattaaattccaggcttacatttttaaaaagagaatcttgtattactcaaggaatacgtcctcagtactatgtaggcatgttatcattgtaacacttaagagtgtggactgaaggttaaagcctctcctgtcccccacctccctccctgaggtcatggctgtgtgtgcaccacacttctctcttttaaaaaatgcattcattcccgtatgtgttcacactcacacatctatacctgtagctttttttctttaacatgaatggttcatactcctcatgttattttttgagatgggtctcacactgtcgcccaggctggagtgcagaggcgcaatcatggttcactgcagcctcgacctgctgggctcaaatgatcctcccacctcaccctcctgagtagctgcgactacaggccaccacatgcggctaattgttaaattttttgtccagatggggtctcattttgttgcccagactggtgttgaacttctggcctcacaacatcctcctgcctcagcctcccaaaatgctggaattgcaggcatgagccactgtgcccagcctaattatactgttttaacttgctctttttgtttagcagcaagtcttggaaacgtttctttgtacgtacagtaggcttaccttctggctgcataaatacttcataaggtgggtgtgctgggatgtatgttgttctctgacgatgggtgttgaggttgctgctttttctctttcccctttcacagtcgcaaatgtgtgtatgcacacggacaagtatttctttaaagcgtattcctagtaggagtttgctggatcagcgggggtatgcgataagagactgccagatcaccctccaaaaaggcttgagcactttgcactctggccagagcgcctgtttccccacactccagcaacgccggatattaagaatcttttacatcttcgttatgcctatagatgaggcatcagatttcgtggttgcctgagtttaagtctcttgaaatagggcctttgaagcaacacatggaaacggaaagcattcaaataaagtttttactaaaccttatggcatatgtaaatatttgtcaaaggtagttatttaaagcaaagtacttaaaattaaatttaaaaaatacttaatcctttatctgtggattctctttctccattttctagtttattccctccggtgtagactatggagtgagggctcctttaattagagttaattaactcttctcaattttgtcctgaagcacatgcctttatgaatatgacctccacccccacaccgccccttccatgcagcgggattcaaaacctctcatctgaggagcattgagttttaattaaatatgtgtgtgtgcgcgtgtgttcgtattttaaaaccccaaagtaaattagtcagcctccctggtgcatctaaatatttaatttgattttcttcctagtagtttctgcccactttcctttttattttaagataaatttactaataatttaggttcttcccctgggagccttctgcattctacactgagtaattctacccactttcaacattgtaaagcctgtatctattttcttagcaatcacaagtttggggattgtttttatctgcttgttccaattagattttcccctagaatcctttactatacaccaatgaaaaagtcccccatggctgtcagacctaaagtaaagcctaggcagggaaaagaagcaggggcggggcagggagcgggggaggggagaggagggggagggaaaggccaattctgccatcctcctctgccacctgccagtgtcctggaagaaacatgctgagaagcgcatgcagtgtggtgttctgccttttgtttttctgttcaataaggaattttcaggtgttcctacagcagtgtctacttaggtcatctctgaccgaagtcacactcaagaagcaggctgtggaactgctgggttagcaaacgctttcagtaaactgactttcaaagggagggaagtggaacttctttaatgtagaaacctccacacacggtctctgtctgtgtctgatcttctgccatggtttgttccaaaactcagcttgtctttccaaatagcctagacagaacaagtttttacaagtgcacattgaaagtacattgagagaaaccccagaatgtgtatgccctatcatggaggaagtaaggtcattcttaacagagtaataattgctcacaatttactggcaaagtctttttcttcctaaattagtgttttctgtataccatcttctctcagtggttccatagttattcagaattcctgttaacttttttttttaagtgaaagcaagtttattaagaaagtaaaggaataaaagaatggctactccataggcacagcagccctgttaactttgaaacctcagagtttatagctatgaaaagaaagaagaagaatgacatgaacaggttgagggatttgctgaggctcacataattcacatgcatgccagagtccgtttacacttcacttttgaattgttcggaaaaaaaaaaaaaaagctaaccgaaatcttcatttcattccgtttgtcatgtggaagcttgtcattgagaatacttaatggacaagtttcctgaacaaaactgtgtaaatcaagtatggcctgacacttgcctggaaaccagcaattctgaaattggaatcctgcttagaactgaatccttacgtggcctgcagcaagtcatttcacatcttacctcccttttttgccatctataaaggataaatacttctgtctcagggatgttgaaaggattaattagttagtctataaataactttgaagatgaaaagtactttaaaagtgcttcttaataacattattgcttagaaaagagtgccacttttatgctaaccactttatgtctcaaattatataaagaaggtatgtttagtacattactacgagttgtaaactagagataaatttcacatggtgtgagcatcaaacattagcttcagaatttcaaagaagcatcactttgtcttaaggatcatttaggagctgtgctctcagtaattagttacaaagatcatatttcagggaaaaaaagactctttcacacagttcagcctttttctttcttcagtcaggtttcttagccatcactttaaagggctgcattgaatttgatctggggcagggaggacaggagacagtatactatttttgaggagggaacagaatagaagagaaccatattctttgtcttccctcgcatctctctcaatcttatcagggggataggaatctattgctttagccatttctagaaaagttagagtaactgtttaaacttactgaaaatatatatcattaggcttaattcagtttatttccctctaaaccaagttaacaaaaagggccagtgttctagtttataataaaacattataacttgcagtgaagtttcattttataatgggtacaaaattcaaacttaacctctttattggaaagcagagggggattgtgttaattacacagatgacagtgaaatgcagggcacagcagactgtaacagagacacagattatataaagagagcctagaaaaatttggaaaatgtgatcaagaaatgaaatgagatttaaatttggaataaagtatgtcagaaagagtaagtcaagtaagaaactaaaaggaaaggtacctggagagatagcagtggctagagctgaatcaggtacagttacccaaagtgtaattgcttttgttttctctcagcgtcatcagacagattcatgtttcaagctgttcatgctgtgggatgatggcttgcagtctacggagttaagactgagtgaaggaaaaacgagaattatcatagctcttctctgtggcttgacctggaggacttaatttgtgctcattcctttgtaaaaggtggacgagtggccaaattactcacatacctaatttgtgtattgtttaaatatatcattatatcataaatgccattgaccattatgatcaattacaggcttcaggagtagattgctctttgcatttggtcttcagaaatatgattgattttagtaagaaaagtagcaggcattgaagtgtttggtcctgccacttaagatattaaattagtgggtgtttttgccagccattgttttacagtctatctctggaatatgaataatgactatttgaatgcacctaattctttcaatttattgtgttaaatgaatgatattttctgtttacatgtgtaaacatttttcttcgctatcaattctaatcaaaacttgtttcaaatggtaaattaaaacataattttgattaatgtggcattcttttgaatttcccatagcaaaacccttgaagatcgtttgaaaattgaagcaaaaaatgggacattgagtgtatccgacaccaccgttggcagcaaacaattgacattcacgttaaagagggtgagttgtcttttattgttattttttaattcacaaaagaaaaatagcctttcaatagtgtttgtgtgtgtgtcctcagagcagccttctcaatgcttttcccctattgaggaagctgtgttccctgttctaacattttccttgcaaccagagcccctggtgggccaagagcacagtgtgtgactgcagcagagccaggaatgtcactggtgttccaagggagacagggagttagtggccctggagttagctctgttggagatgaaccagccatcttggtttctggattgctctgtagcctcaggtgcggcttataaagcaaaagtcccatcctgaccctctaaagatgtagggctactacatcctgaccctctgaggatgtagggctacctcgcatgtatatggactttgaagaagaccgggaattggcgagttctgataacttgtgacagtcacacccagcttgcccagatactatccttttagaagacagactactctgcccgtggtcattctattctaaattgatttataagatcctttttttttagccagtggtaataatacgtgtcacacattgtaggaggagtaagctgcttaaatatttactgttaactggatacagttttatttctcaaaaaatttttttctcattcaaagtcagtcctcttcaatatagtcaccaaatagaacagaatgacaaagatttcatccctttttttttccttaagcagtagtagggagattattcttttttaaaattgagatataattcacagaccatatgcatccttttaaagtgtacaattcagtggttcttagtgtattcactgagttgggcaaccatcacactgtgtaattccagaacattttcatcaccccagaaagaagccctataccctttagcatttacccccatcttttcatccgccagcccctggcaaccactaatctacttcctgtctccatagctttgcctgttccgggcatttcatacaaatggaatcattcaatgtgaagtctttcatagctggcttctttcactgatcataatgttttcaaggtttattcattcagtggtgtagcttgcattggaattgcatttctttttatggctcaataatataccattgtacgtatataacacattttgctattcattcgttttttaagggacacgggttgtgttcttttggggtaagcgattaataattggctgtgaaaatgaatgtgtaaatttttgcatgaacatgtgtttttatttatcttgggtctatacctaggagcagaattgctagtgtagctatttaactttttgagaaacctgtcagactgttttctgacagtggctgcaccattttacattcccaccaagcagcgtatgagggttgcaggttttccacatccacaccaaacctgtctctgtcggtcatctttattatagccatgctagtgggtgtgagtggtgtgttgtttgatttgcaggtccctaatgactaatgagttgagcattttatcatgtgcttattggtcatttgtgtgtcatctctggagaactacctcatcacatcctgtacccattcatctctgatttctctaaaattttcccaacgtgcatccaggaggcttgccaagtaataaaaaacttcattattctaagtgcaaaaagcttttcagttaattctgtctgctgagagcaaatttgccctcttacatttatcacttacgtaagccaaatacacattcagagggacctcattgtgcctgttcctaatttcttatcaattttctttatacctggaaacattcgttgattccctctgaaactcaagtgatgtcaaatggggcaggagcagcacagcctggaaggatcccaggtctgcagcacagccacctcagctcctgcagaggcccctctgctgggttgagtgagcacctaccttgcagtaacatgaaaatacaagccttttcccactgtttctaaatcgggaggtactgagttgaagatcagtttaaaatttgtagtaaaatgaaaataagatggctctgaaattatatttttgtttataaaaaaagtattaagaattgctttaaatggcctcataactgaatcaagcagaggctttgaaactgttttgaggactgtgtcaattaatgtttgatgtgtgtgtttccttacttgacagacattttaattattaaatctcagttttacttgagttctagtttacagtaaattttacttattcgggcagttgttcatagaagtctctttttatactgcatgttagatatgctcaggtagaatcttgagtttttcctatgtttgcatatgtacctcctaaaatttcaataaaattgaagagagaaaatccatgctttaatgtcgtttaaaattgtatagtggcaaaactgggattcagtcacaaatctaattttaaaatgccatttagtacagttcctcatcaagcctgagactgttgctgatacaaatgtgcctgtttgcacctgtcctcctcctccctctgtgacaggagtgctggaggctgtggtgaagtagtcgggaagaggaggcagaagcacccaggagaagcgctaatggcccatagatcccatcctcctgaatccgccacatggcggcaaggccttccagatgccgccttgggagagaggctagtcatagtcctttttctgcatggaaatttgtctgcagaacaatagtcactgcttacaagctcctcttgaagctcctaccttggtggagaaagtctggcagagcttcccaaaatgtgttccaggagatgtaaatggtgactctggaagattacttttgccatcagacagataagggaaaaaccttggactgatgtccatgttgaagacttatgaaggtaccttaacttagaagctccaacacacacaccttgtttatctgtatttagcacatgattttccaaaattatatgaagaaaccctttttttttttttttttgagacagagtctcgctctattgcccaggctggagtgcagtggcaccatctctgctcaatgcacgctccacctcccgggttcacgccattctcctgcctcagcctcccgagtagctgggactacaggcagctgccaccatgcccagctaattttttgtatttttagtagagacacggtttcaccgtgttagccaggatgatcttgatctcctgacctcatgatccacccatctcagcctcccaaagtgctgggattacaggtgtaagccaccacatctggcctgaagaaaccctttttaaataaacccctgattaacatgaagaatcgaaatattgagtaactggtgttggttcactttacagggctcctggtggtgtcatcacttgctcagctagggagtattagaaggagttctgagttttccattaacgcatgtgtattgatgcctgccctgtgctgcatgctagggacagacatggctcttgccaccacagttctcagtctactgggagagagagacagcgggtaaaaattatacacctctaattatatcattagaactgcggcaagtgcttcaaaggagagcagagggctgtgagagtgtttggtaagggaccaaactgcacagtttcagtaagcacaggactgaactgacatagtatttctattttttttaaatccttccggttgctgcatggagagttgcctcaagggatatttgaaaggaagcagagcacgaggaaggcagctccgtggtggccatgcttaggagcggcagcagcctgggcttgggtgggaccctttgagacggagcacagtggaggagtttgggacgcacttcagaagaatacacaggacaggatttactttgaaaagacagttgaagaatagtaatagtcagagaagggacttaagaattatgcagaaacccggtttaagaacttattagaatgggagaaatgcatcctttttttttttttttttgacattacaaattgctttccttccccgctattctctcacttgcaactcttcaattttagaagagtgggtaatatccacaagaggtgaatccactggacactttctcctcaagggtaacacacagatgcatgtgttttgttaggtgtgtagaaaatacagatcctggctgggcacggtggcgcacgcctgtaatcccagcactttaggaggccaaggtgggtggatcacaaagtcaagagatcgagaccatcctggacaacatggtgaaaccccatctctactaaaaatacaaaaattagccgggcgtggtggcgggtgcctgtagtcccagctactctggaggctgaggcaggggaatcgcttgaatccgggaggcagaggttgcagtgagtcgagattgtaccattgcactccagcctggcaacagagcaagactccatctcaaaaaaaaagaaaatacagatcccagagaagcaggttccctgggtgtccataagacggtgcttttccgctttatcaactgaggcccctgacagtgctttctcagtttaccatgtgtgcagttccaccgctaagaaatttttttttttttgagctttaccttcaggagtttgtattttcaaaaccatcaaatgtgtttttaaaaccgtgtaactcttaacctttgttgtggattctgcactgatgctcttctaagaatttctgctgaaagtagttaaaccatttggcgccagggatggggtagggaggagttccagctcccatgtgagccaatgagcattgaggacaaatgtgagcacctttccagcagtcagcccgagagtccacatggttattgcagctgtgaacgtgtgcatcgtctgcctggcttttatcagtgattaatgagagcagtttgctgcttttaaggagaagtggagttttgggaaacagctaaaaattctttggagcaagttctagtgaatgaatgctttaataacgtacttttagtacatttaagtattttttgtttttaaaaacagtgggaataaactaatggctctagtttgtaaacaaagatctctaaaaggaagtggacactctaagtgatatcatcttcttaaggtggctcttgtgtaggctcttttaaaacatcccagtggttgtgtgagtgtgttggttgaaaaaccagtctcctactttgtaggaggctggtctgtcagggcccttctcttgcctggggttcagaatttctgcttttgcattgatggtaaaagttggccttggtcctgctgtttctgccagggtagcatttgtcagagcagagtccaggcagccccaccatgtcccctggagcctgtgggcagcatttctcctggcagcagttctgagattggtggtggtactgttggcagcctgacggttaccagaaaagaggtatagaattttctctctttccctctactcatttcattttctcttttagtctgaacagcagaagaagcaacaggaggctgagaaactgcatcgacaagaaaggaaaagactccgtcgttcggccggacacctgaagtcaagacacaaaagaggacggtcgtttcattgatttgggaagtggtcctacctgtgattagggaggggtacgtctcccccaaactgatcatcgttagggtgttaaacacagacgaggaaacacacgtttttaaagttcatgtacgttcttgtacacagaggtaaagatttgaaaacctgtgccttgtgggttggactttgaagctggccccgccgacggccaccgcacagccccaggggtgtgcttgcgagtcgttgctccctggaaacattgtcctttccccacggctttaatcatgaaaaccaggctggggtttttttaatattgtgaaatgtacaccatgaaatgaaaggtttatcctgtgccagaaaccaaggtttatcatgctctaggaacttttttcttacactgcctaccgccattcatgattaaaccatccagaaataccatccctgttttacctggtgtctgtgtattgcctgtgtttgtgtttataagtttatgctgataggtttgttcggcttgtttatgtattagtttgggatttgtttttaaataatttataccaagagagtataatctaatggtgcaggttgagagcatcccaaatccgaaaatctaaaactgtttgagcactgtatttatctgttcttgcactgctataaagaactacctgaaactgggtaatttataagtaaagaaaagaggtttaattgactcacagttctacaggtggtacaggaagcatggctgtggaggccctgggaagcttacaatcgtggcagaaggtgaagcggaagcaggtatgtcctgcgtggctagagccagaggaggagggcaaaggggcagatgctgcacactttcaaacaccagatctccaagaactcactaacacagaatagcaagggggaagtctgcccccatgtttcagtcacctccctccaggcccctcctccaacaccgaagattacaatttgacatgagatttgtgtggggacacagagcaaaaccatatcaagcactgacatgacattggaggaaaatgctcattagagcttttcaggttttggattttcagatttgggatacttgactagtaaatataatacagatattccaaaacacacaaaaaaaccaaagtctaaaagacttctggtcccaagcatttcagataagggatacccaacctgtaataatgggaaacaagcagtagaggctgttggttaatcttggcacaagtttaattacaggttttttttttttcctgtttcttaagtacagtcaaacataaacttactggaggaaacatttataaaaataaatatactttcatttgaatagcttctttgagaaagactccaagaaaatttttttttcattagtcaaacggtggtgtgcacttgtagtcccagctactgaggctgaggtgggttgcttgagcctgagaagtcgaggccagcctggacgacagagcaagacctgcgtctcaaaaaaagaaagaagagaaccaactttggtttccttagtttttccagctttgatgtgattttggaggtgcctttatagatttttaaggttctttatatacaactgaaatagtaactctttggactgtgaatgatacagcctaatttcgaatagcataagccgagaggcagaatgcattaatttacatcaccatgcttgggacatggaactggcctcaggaacacctagatccatggctccacggtcagtcagctagcacatgcgcactctatctctgtttccctctttctctctctctccttcccctactccctcccttcctcctcctgtctcaccattgttccttctctcttcaggcctcccctgctgtcttttccctatgtgtttcccgtccccctgcctctgctctctgtgctgcttctgcttctgtgcagattggcttgttcccaaggcagggaacagctcagccatgtgtccacttctgtggtccgagaaatgaggtctgtttacagaaaaaaggtgtgtggaaggtggggtatgtgtgtatgttcttgttcctggggcacccagccccatttgtgctgtggtaccagggagtcctccagctgttccaacccctggaccggtactgtcctttttcagcttctttccccctaaactcttgctcactgtccacctcttctcaaaggaagtggctgcagcttcctgttgccttctcttctctgtttctacgctgcctccctcagggatggggggttttaaaaatttagagagggacattttgctggctggaatgtccccaggggttgggtgtttatgcccttggcctgtttcctgacgtcagggtctgtcacgtctactcctggctttcccaggcccctcttttccttccttcttgaagggcctcctggttctgtggggagccagtattccgcagggccagattccacaggcagcggtgctctctgttcacccagcactgtcagcacaccaggaggtcaggacatcagggtagaggaggagggccaggatcacttctgggcacctgggaggctggcagtttagtagaaagagcttgcatttggaaccaccctgacacagggtcgaattccaggtctgttgcctactagttctgtgtcttttgactgttgccttaatctctgtgaatctcatttcctcctgtagatcagcctaatacttagtttttattagagtaaaatgaggcacttacattaggtacagcacctggcactgtgcaaggctcatgaggatttgacaaagcttcttgaccattgagggttttcaagagcaggggaggtgacctcggcttttgttctggagagttgctgaagggcaggcggagggactgccctgagtctgagggacacagaaggagtgtccgctgacgacagctatatgggtactcctcctaggcctgacccgtccctcattgccccagttttcctaccgattcagcccttaacgcaggcctgcctcttcagggctgattcccagcgtgcctgctctaatccttcatgtcttcgaagtttcctgtttccaagttttattcagctttcatactctactccataatttttccgtgtgtgtgatatactactcactagtcctaggaaatggccatttcccatgggtctctgtcccaggcacgcacagctgggggtgttcatgagccagtgcgagaagcatttcctcacagatggggccccgagggcatggcttttacagcgggactgagctgggggttcctgggctgccatttctccccttcccctgctccagatcccctcagcctctgacaccccagacctaaggcccaagtttgtttatttgtttccaagtttgtgctcagcagttaggataatggtggctttggagagaggggggaacatggctgggagggacgtgatgggggatcctgtttggtcttgttccctcacctggtggtggcttttcccacgggcgcactttgatcactcctgggctgctcacgactcatgtctctttctctgtgcttgttatccttgaacacaaagtttcattgaaaaagaattactcgtgttagccaggatggtctcgatctcctgacctcgtgatctgcccccctcggcctcccagagtgctgggattacacaatgaaaccctgtctctactaaaaatacaaaaaattagctgagtgtggtgacaggcacctgtagtcccagctactctggagactgaggcaggagaatggcgtgaacctgggaggcagagcttgcagtgagccgagattgcgccaccgcactccagcctgggcgacagagtgagactccgtctcaaaaaaaataaaaagaaaggaaaaaaaaaaagaaaaagaattgctttatcgaagggacatgtttcatggctcctcacaaaaccatttctatagataactcataacactgtaaggttatgttttttagatatttttctgttctatagacaatgatagacacatctgttttaataatacaaatgggatcacactatatatgctgttcctgaacttgatttttgtaactaacaatatattagagatattttcccaggtctatacatattaatatgtagggtgatctacctcattcttttgtatagagtatttcattacatggctgacccataatttatttaactctctgtctacatacagttcaacctaaaaatctaaagaaataaccttttaaaatcttttttcaaaaaaagtttacattcaaggagacacgtgcttgtttgtgagatgggcatattgcacactggtgaggagtgggcttccaatgcacccgttacccaaatagtggacactgcatccagtaggcagttcctcaacccttaccaccctcccagcctttggggttccctgtgtctgttatttccatctttttttttctttttctttctttttttttttttttttttgagacagagtctcgttctgtcacccaggctggagtccaatggtgcaatctcagctcactgcaacctccgcctcccgggttcaagtgattctcctgcctcagcctcctgagtagctgagactacaggcacccaccaccatacccagctaatttttgtatttttagtagaaacaaggtttcaccatgttggccagactggtctcgaactcttgacctcaggcgatccacctgcctcggcctcccaaagtgctgggattacaggcatgagccaccatgcccggccagttatttccatctttatgaccatgtgtacccataaaaatcatttctatagtaagtataacccaagttattttttaaatgaatgtagtaactttgcaaagcatttgtatgtagtaaaacaatggaaatgtcatttcggttatcattttctttctttttttcactatatggagcttgatagttttaactccaccagttagaatagagttttagcatcttttttattcatttgtcagaagagcagaaacaaatactttataacatttttgttataaagtaacaaaaacaatcttcataacattctcttaagtaccatttatggtacaacaattgaaattattaaagttcctgggacatttctatggatttcccatctcttacgaataaccccgtgttattcttcagctacaggagagggtggggtgcgtggggctggggcagaagcaggagatcacttgggaagcgccatagcatcgtgggtgggtgatggggctggcccaggggtaacaagggtagagccccaataggttttgcaggtaggattgacaggatgtggaggagaggagccaggcatagctctgacatatttggccttagcaatgccaaaggtgggactgtccttgcctggtaccacaaaaaccacagcagaaataagtttgggggtgaggaggtaatgagggattctgttttgaccagaatcagcttattttattatgtacgtattatttatatggggacaggttctcactctgttgcccgggctactgtgcagtggcatgatcacagctcgttgcagcctcaacctccagggctcaagtgatcctcccccctcagcctcccaaagtgctgggattacaggcatgagccattttatttttttttatttatttattgtttttagagacgggcttgctatgtcgctcaggctggtcttgaactcctggcctccagtgctcctcccacgtcagccactcaagtagctggaattgcagacttattttagattgaatgcttttcatttttctctttttgaaacaccctgtggttcatgttcttactcagagtaacagtccatgtccccatagcagcccacaaggcaccacgtggccccggctggcctgtccagtgctctcccctccgtccgctcgtcctctgcatgctggcctccctgtcatttctagaacactcaggcattctcttaagccaaggcctttgtagttgtgattccctctgcatggaatgctcttccccagccatctcctgtcactctctcacccaccccatgaggtcatgaccacgctatttagattgtcacaccccatctcctggattgcagatgagatgatatgcaatgtgctttttaaaaagactactatggacaatgtctaacatataccaaagtagagacaaatttaatgtgcttccatattcccagcacctgcttcagtagtcaacagtagctgaccctgtttcatcctcacttctacccattgtcccattattttgaaatatttgatccccagacgtcctattgtttcattcataaatcttcatagtggcttacttgtttatggttgattcgccagccccactcccttccatagcagcctagtaagggtagggatgtgggtttggatgcgttttgctcattgctgtgtatccagcatctagaacaatgtctggcacctcgtagctacttatcaatatttattagatgaataattaggtcaagtttgatgaagcctgaagattgaactctggctttaatacaagaggggtattaaatgttttgactgcagctgtttgagaggggctgggaatgctgaaaagcctaattggaatagttgaggagagaatggggaaaaggaatcagaaatagcgattatgcacaacagctgatacaggggaacagaaaataggacatctgagatcaagagagagctttctttaagagggtagatattatagcctgtctgtgtgcccctgggaatgatcaggaaagactgaaagcgatgatgccagacagagggcagctcctggagtgatgtcaggaagtccgtgtggtggtgctctgtcgctgcataacaaactacccactacttagaggtttaaaaattaaaagcaagttagctcacagtttcagtcgatcaggaatccagcttagcagggtgattctgtccaagttcctcctgagggtacagtcatctaaaagcttgtccggggctagaagaaccctcttccaagcttccacacatggcttttggcaggcggccattgttccttgccacatggcctctccacagggctgcttgaatgtcctcacagcatggctgacttcccccagagcaagccatccaagagagcaagagactaagatgggaaccacagtgtcttttgtgacctagtattagaagttgcatgtcatcccttactctgatttgttagaagggagtcactaagtacaaagtagggtggccagacatccaaataaagataaacaaaggcttattagtataggtgtattccaaatattgcatagggaattcttacactaaataatgactttatctgaaactcaaagttaatgtatgacctgtatttttatttgttagatttggcaacttcagaaggaatttgtggacatacttttaaactacggctagccaaagggaatgggatgtagtgcatatgtagagctcaggcctacagaaacacggcagatcatagggagagggctggcggagtacttggcaaatgtagataggtaggcgggtgggtaggcagaggcagtgaggggagcaggtggacatgctcttctgattgcttctcttttctcaccggagtaagcagcaaggttatgggcaaggtaaccttctcccgccccgccatacaccttgcacagagcttacccttgactcagaccctccatgctgggggaattacctccctgtgaccatcctaggaagacacctcttggctcttgcagagtcagaaaagcacaggacatggagttgagaaacccggtttcttctttttcttctttttcttttttttgagatggagtctcgctctgttgcccaggctggagtacagtggcacaatctcggctcactgcaacctccacctcccgggttcaagtgattctcctgtctcagcctcctgagtagctgggattacaggcacacgctgccatgaccagctaattttttgtattttagtagagatggggtttcactgttgttgcccaggctggtctcgaactcctgagctcaggcagtctacccaccttggcctcccaaagtgctaggattacaagtgtgagccaccgcacctggcctgctttttcttttccctgttatggcctctctgggtttccaaaattctatctcttttttctcttttttttttttttttttttgatggagtctcactctgtcaccaggttggagtgcagtggcacaatcttggctcactgcaacctctgcttcccaggttcaagtaattctcctgcctcagcctcccgagtagttgggcctacaggcatgcatcaccacgcccagctaatgttttcgtatatttagtagagacagggtttcaccatgttggccaagatggtttcaatctcctgacctcgtgatccacccgcctcagcctcccaaagtgctaggattacaggcgtgggccacctcgcctggcaaaatttttttttttttttttttttttttttgagacagtgtctcactctgtcgcccaggctggggtgcagtgacgcgatcttggctcactgcaacctccgcctcccgggttcaagtgattcttgtgcttcagcctccctcaatgttttttttactttgtcccacagtaagaaatccatttgacatcatggtgcagaatacacgtacatcaaaggtattagaaaattgttatcttgcatcatacaaaggacgctgttatttttctatccagtcctgctctagttcctttacacctccccccaaaaaagttcacacccattactatggttccaccacccactaatgagggctccaaccccgagttgagaatcactgcctactaccctaatcaactgatggcattcttgcaggagtatgttgacaaagcccatactgaaatgtgtcccccaaatgtgtaattcttcctattgtaatgtgataaattgtgtaatgaaacgttttgctggagttttatgagaattttttttgactgaagacacgagatgagtttttaattatttttttcaaagctctattttcagcataaattaagtacaaaatatattttatggaatagttatagggttttttaggaaaatttaaaagattttgtggttctttctaaggaaaactttcaatgtgttaaaaacctatccagggcctggtgcagtggctcacgcctgtaatcccagcactttgggaggctgagacaggcagatcgcttgaggccaggagttcaagactagcctggtcaacatggtgaaaccccatctctactaaaaatacaaaaaaattagccagatgtggtggcaggtgcctatagttccagctactcaggagactgaggcaggagaatcacctgaacctgggaggcagaggttgcagtgagccaagatcgcgccactgcactccagcctgggcaacagagcaaaactccgtctcaaaaaaataaaaaataaaaacctgtccaggttttttgtttgataaattttgtttttgaaatgattttcaaacctaactttacccatgtagccatgaagttaaaacaaaatcctagagtttatgctgtcattgtaagcaattacagatgatggccattacaaaacttcattttactctttgtggaagactagtctccatttcatatgcaatagaagattcaactctcttttgcacttgagaatactaaaagtaaatgtattttagtaaagaaaaaaaacccacatgtaaatgaatgtgtgtcttggagcaactgaattctattcaaaactttggaaggaaacagcaaagtgttagaatacgtgatttttaaagtgtatgtataaataaataccgtgagtaaatatttgcttatttctttgacatccctaaaaagtttatatatacaagttggcataattttttttcttccccttgggaaatagtgtaattgcctttatttggagtttccttatattaaccatttataattatagtagcttgatttaggacattacacatctctttgaacgtggggaaattttcagtcctgaaaatttttatcttacaattttttttattaacgtgtacattttccaaaattaatgcaataacaaatctgacagttaatatttgaaagaactattttggccagcatgctgcctcctactcaaaacatctgatgttccccatgagcacatactgggtgaatggaaacttctaagaaaatgtcagtccttacccttggagataggacggcctgaggcaggagtgtcaggagggacacaggtcaccatgctggtgcgggctccgggtgtgcagctccctgcagggggtggaaccctccccactccctgggcatcctgcccaatgagagtcccagatgcacatcttaatgcacgaggaagttattattctctcactgttgtcagttgcagaccctgtttgtgactattctgtaaacccagatggaacttcaaagcggtagggtggagggaggccaactatatttttctggtagccttaggtttctttccaatgtaggacaaaatcacgaatctcagcctctcaggatttgagggatcttctagttgaactggctgagacgcctacctgattggatttcccgagttgccttctctcccatttcagatgatctcattgtgagttgagatttggagaatcaaaacctccctccccgccctttccctagcttcctcctgcccttgctaggtctgccttccagggttctgcagaactgctctgatttctcctggcgctcccttctctgtccccatttccctctgcacatcacccctttccttgctgggacccacctccagtcccctccactcaccactcaagctcgtgggagaggaagctcatctcctgatctccagccttgctagcctccctgggagcttcgacacggcctccatttccctcttgtcctcggcctccttggtctctgccgactcctcatcctcacccacgcaggtgttaacatgctccaggatgtcttctttaagcctgtcactcttccttccatagtgtcacctctcttcagtgtcccagagctgcctcccagatagcctctgggcctttcatctgggtggccgctggcaccttgagttccacatgctcaaagcaaaactcatccaccccatcccacccacccgaacacttgctgctactcctcattcgcccgtctatcaacctgagccagaagtcacagttcctgcaagcactacttatcgagcactctgcagttgactcagcaaaaagagccgtttacttgagtttatgtttcacgggggagacagacgatgcatccagtagacacaatgcaggccacacgagccattgggcaggcaggagagctgggagggcagggctg

SEQ ID NO: 2039 - DNA, 3331 bp, Homo sapiens
cggcgccagcggccgcacgccgcggagcaggggctcggaggtcccgggattacggtgctcgagcacgctggtgggaaaggacccgggacttgaacagtgttgtgcggcgccatgcaggtctccagcctcaatgaggtgaagatttacagcctcagctgcggcaagtcccttcctgagtggctttctgataggaagaagagagcgctacagaagaaagatgtagatgtccgtaggagaattgaacttattcaggactttgaaatgcctactgtgtgtaccactattaaggtgtcaaaagatggacagtacattttagcaactggaacatataaacctcgggttcgatgttatgacacctatcaattatccttgaagtttgaaaggtgtttagattcagaagttgtcacctttgaaattttgtctgatgactactcaaagattgtcttcttacataatgatagatacattgaatttcattcgcaatcaggtttttactacaaaaccagaataccaaagtttgggagagatttctcttaccactatccatcctgtgacttgtactttgttggtgcaagttctgaagtttataggttaaacttagaacaaggacgatacctgaatcctctacaaactgatgctgcggagaataatgtttgtgacataaattcagtgcatggcttgtttgccacaggaaccatagagggtagagtggagtgctgggacccaagaactcgaaacagagttggcctgttagactgcgccttaaacagtgtcacagcagattcagagataaacagtttaccaacaatctctgctttgaaatttaatggtgccttgaccatggcagttggaacaaccacagggcagggaaaaatatttacttccttggagccagagcatgaccttaatgatgtttgtctctaccccaactcaggcatgcttctgacggccaatgaaacccccaagatgggcatctattacattccagttttgggtcctgctcctcggtggtgttccttcttagacaacttgaccgaagaattagaagagaatccagaaagcacagtctatgatgattataaatttgtcaccaagaaagaccttgaaaatttagggctcacccacctcattggatctcctttcctccgggcatatatgcatgggtttttcatggatataagactctatcacaaggtgaaactgatggtaaatccatttgcttatgaagaatataggaaagataaaatacgacagaaaatagaagaaacacgtgcacagagagtccagttaaagaaattgccaaaagttaacaaagagctggcacttaaattaattgaggaagaagaggagaagcagaaatctacatggaaaaagaaagttaagagtcttcctaatattctcaccgatgatcgatttaaagttatgtttgagaaccctgacttccaagtagatgaagagagtgaagaatttaggcttctgaatccacttgtttcaaaaattagtgaaaaaaggaagaagaaactaagactcttagagcaacaagaacttcgtgaaaaagaagaggaggaagagccggaaggaaaaccaagtgatgcagaaagttcggagagttcagatgatgaaaaagcctgggttgaagaggtcaggaagcaacgcagactcctccagcaggaggaaaaagtgaagcggcaggaacgactcaaggaggaccagcagacagtcctaaagccccagttttatgagatcaaagcaggagaagaatttagaagcttcaaagattctgccacaaagcagaaactgatgaacaaaacccttgaagatcgtttgaaaattgaagcaaaaaatgggacattgagtgtatccgacaccaccgttggcagcaaacaattgacattcacgttaaagaggtctgaacagcagaagaagcaacaggaggctgagaaactgcatcgacaagaaaggaaaagactccgtcgttcggccggacacctgaagtcaagacacaaaagaggacggtcgtttcattgatttgggaagtggtcctacctgtgattagggaggggtacgtctcccccaaactgatcatcgttagggtgttaaacacagacgaggaaacacacgtttttaaagttcatgtacgttcttgtacacagaggtaaagatttgaaaacctgtgccttgtgggttggactttgaagctggccccgccgacggccaccgcacagccccaggggtgtgcttgcgagtcgttgctccctggaaacattgtcctttccccacggctttaatcatgaaaaccaggctggggtttttttaatattgtgaaatgtacaccatgaaatgaaaggtttatcctgtgccagaaaccaaggtttatcatgctctaggaacttttttcttacactgcctaccgccattcatgattaaaccatccagaaataccatccctgttttacctggtgtctgtgtattgcctgtgtttgtgtttataagtttatgctgataggtttgttcggcttgtttatgtattagtttgggatttgtttttaaataatttataccaagagagtataatctaatggtgcaggttgagagcatcccaaatccgaaaatctaaaactgtttgagcactgtatttatctgttcttgcactgctataaagaactacctgaaactgggtaatttataagtaaagaaaagaggtttaattgactcacagttctacaggtggtacaggaagcatggctgtggaggccctgggaagcttacaatcgtggcagaaggtgaagcggaagcaggtatgtcctgcgtggctagagccagaggaggagggcaaaggggcagatgctgcacactttcaaacaccagatctccaagaactcactaacacagaatagcaagggggaagtctgcccccatgtttcagtcacctccctccaggcccctcctccaacaccgaagattacaatttgacatgagatttgtgtggggacacagagcaaaaccatatcaagcactgacatgacattggaggaaaatgctcattagagcttttcaggttttggattttcagatttgggatacttgactagtaaatataatacagatattccaaaacacacaaaaaaaccaaagtctaaaagacttctggtcccaagcatttcagataagggatacccaacctgtaataatgggaaacaagcagtagaggctgttggttaatcttggcacaagtttaattacaggttttttttttttcctgtttcttaagtacagtcaaacataaacttactggaggaaacatttataaaaataaatatactttcatttg

SEQ ID NO: 2040 - protein, 644 aa, Homo sapiens
TVLCGAMQVSSLNEVKIYSLSCGKSLPEWLSDRKKRALQKKDVDVRRRIELIQDFEMPTVCTTIKVSKDGQYILATGTYKPRVRCYDTYQLSLKFERCLDSEVVTFEILSDDYSKIVFLHNDRYIEFHSQSGFYYKTRIPKFGRDFSYHYPSCDLYFVGASSEVYRLNLEQGRYLNPLQTDAAENNVCDINSVHGLFATGTIEGRVECWDPRTRNRVGLLDCALNSVTADSEINSLPTISALKFNGALTMAVGTTTGQGKIFTSLEPEHDLNDVCLYPNSGMLLTANETPKMGIYYIPVLGPAPRWCSFLDNLTEELEENPESTVYDDYKFVTKKDLENLGLTHLIGSPFLRAYMHGFFMDIRLYHKVKLMVNPFAYEEYRKDKIRQKIEETRAQRVQLKKLPKVNKELALKLIEEEEEKQKSTWKKKVKSLPNILTDDRFKVMFENPDFQVDEESEEFRLLNPLVSKISEKRKKKLRLLEQQELREKEEEEEPEGKPSDAESSESSDDEKAWVEEVRKQRRLLQQEEKVKRQERLKEDQQTVLKPQFYEIKAGEEFRSFKDSATKQKLMNKTLEDRLKIEAKNGTLSVSDTTVGSKQLTFTLKRSEQQKKQQEAEKLHRQERKRLRRSAGHLKSRHKRGRSFH

SEQ ID NO: 2041 - DNA, 37075 bp, Mus musculus
  misc_feature (1)...(37075): n = A,T,C or G
nnnnnnnnnnnnnnnnnnnnnnnnnnnnnnnnnnnnnnnnnnnnnnnnnnnnnnnnnnnnnnnnnnnnntacacacacacacacacacacacacacacacacacacacacacacccctcactcctttctaatctccacccttaaattcattcttcgagttttctggaaactccttgacttgggtgcctgttggttttctaggattttagccccctgaagttatggagtgctgaatttaaagacatccttcactttcttcccatttcactccttcctgcctattatcaccaaatgtgatggatacatatgagattctgtgggtgtgaaatgtgaatgtggaaactgctaagggctaaattacaactcagagcccaagagctaacgtagttccatctgggcaataaagcttatttctgaattcttattttgaattcaggctctttacctgttagactcgttgcaaacatatttagtgtggtaaaattttagatatcttcatcttgagccttgtattaatttcctcagactattgtaacaaaaaacaacaaatcagagggcaaacaacagaaagttaaagttttggaagctgaaagtgtgctgtgagattgctggcagggttaagctttagccaaagagtctttggatagcctttgtttgctttatcttagcttctggtaagttccatcattccttaggttttagctgcgttccttcaatctctgtcttcttccccacatggctttattccctctgctgtttatctgtctgtgtggtcagtctctcctctcaaaacaccaatcaatagctttacaggacaccccaatccaacatgacatcaccttactaatctcatagacagagattcttcccccatcccccggccccccgaagtcagattgggatgttccagatggacgtgaactgggtgatgacctactacaatccttcctccttaagttcctcaaccagtttgcttaccattttatgctttgaattttcagcaggtgtgtttcttactttttaaagaaaaaaaaaaaaaaggaaaagaacacctcagagttatttgtctcaagacaaacgttctttctttctttctttctttctttctttctttctttctttctttcttttctacttgtttttgtttttgttttgttttgttttgttttgttttgtttttttgaggcagggtttctctgtgtagccctggctgtcctgaaactcactttgtagaccatgctggcctcgaactcagaaattcgcctgcctctgcctcccaagtggtgggattaaaggcgtgcaccatctcacccagcacaaatgttctttctatagtttatcctcttatgttcccacctccccgagtttatctttacaggttctttacaaagaacatagccctcccctgaaagaaagtaagatagtttagtctggagccaaggaaatatgaggcacaatggtccaggaacacagatttgacttattccaaatagtctccatatgctccagcctaatggcttccttgcttttttgtttgtttgtttgtttttttaaatagtaacagaacaaatcaaacattaagtcaaaggtctttctaaaacgcatcaggtagatggtagaaatgtttgttaaatgtttgttatgtgatctgatgttattctggccgtaagtctgtagatcccaatgatttacctaaaagctataatgaggttggcaataaatggctattaaggagaactgaagatcgcccaagactgtgcagcttactcctaatcggtaatattctagctctccataatcaaggacgttttaatcacccaatcagccttggggatgtttaacactagtgtgctcccctcacctctgaacatcagtttagtcctatgctttaatatttaactgcaggcaaaaatgatctttcataaatggccttatagagagaacacggaaaagacgaagctcaagcttatcaatctaaacttggctttttatgatctgacttccaatcttacttttcggttctgcccctgaacctatctgcaggcttccgaaatgtccctgcctcgctattgctccatactcgggttctgcctcaaggctggagccatgcctactaactcacccactctccccggcttctgcgcctccacggtcataccttggaaatctgttaatgtcagccctttactcttactcttaaatcgatcacatgaagcaatctaattcaagatggcacagaatgttgtgcttgctcaactacgaccccacagccgaggtcaaggccacgtgggctccagaggccgcgctggcactgaggaacggtgccagcagaacttttaggggaccaaggatgaagttctgtaccgaggtaagtactacccggcatcctaactctctcaactccacaccgcccagccgcgtgtcctgcccagcctccaacatcccccaacaccacctactgagcccggacatgcgcagtgggcacacggcgcgggccgctccaggctccgcggctcaaatccgctctgcgcaggcgtcctccctccattcccagccccgcccgttccaggtcccctagcctctcgccacgcccccttgctgcaggtcaaaggtcgcggggcgggccacagtgacgcttacggaagcgctctgcggactcgcggggtgcggggcagcgcagccacggtaccggacggcgggacggcagggcccggcgtggccgcggatgatcggggaaccatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacccagaccgagcagtagagagtcgggagtgtggaccctgtcacagctcggtcacccaggccgccacactcccgctttgacaactgtccaatcctgaagttagggaaagcgctaggaatttgggaaagaaatccagagaggcccctttaatgatccactgactccctgtagctcttttcccctaacctagctcggaggaagtgagttcgccccagtaacagccacagaattgtcctgcgatgtcaccacttgaagagtttcccacctgttggacagactttggccacaggctggccctctccgttttaccccgtcagaccctggctaggtattcctaccactctttgcttttacacacacacacacacacacacacacacacaggcacacagttttagagcagttccttattgactgtgaagaaaaacagtaagttagaagcgatttcactgtgcagggtttggaggtgtctactgagttcgtggcacagttctagatgtctttggacttagaaaatcaaaagctccgacagtcagttttcttatgatccaaaagttaaagcataaggtgtgtctagatggacctttagagctctttcaatttcctaagaaggggtcttttgaagccttgttaaggaagacgggatataatagcagctcagttgtgaggtgctttgcggtgggctttgaccgctttcgtttattgagcgcccgagtgtgatggtaattattcctgtaatgagctagtggtaacaggaaaggtatagagtgggaagccttaaccttctctaagagctaggctgccaattagcgttagtgacattgtctgttagctttgggacttggggagcttttagctctttatttgggtcagcattatctaagcttcagccatagttgctgtagtcaatgaatctagatagcctggtttttttaaatgaaatgtcctgattcttaagtagggacacttatttttctttctattgagctcctttatattacagggccatgtttgagttggtctagtctgtggttgccaggttgaaactgtctaggttagagatgtctctttcctctgctcttcctctgcttcctgacggctctgcctttcagcctgctttcctagtccattcctttcctggatgcccagccttttaagccctgcacctcagtcttaccctagcagtttcacatgccttgaaagatacctgagcctttgaggccagaaccacattctccaacgtacacacagttgtttggaaggttttctggtgtggtggttctcacgaacaccttggggaacggacctcaaagggaaggagtcttcacactgctgttagtcttaaagctgaaacctgggtttgtcatctcactcttgaggaaacaggtgcggattgtgttgttaggcagggagaaacaggtaggagattttaagaccatggttcttgaccaccctccccccccccccccaactccctaccccttacccccttcttcttgacctcctcagcaacactggacagagaggcatggcttataaccacgcctatgtttgtaatttgaatgttattagctgtttctttttttccttactgcctgtgttggctttaattgacccattttctcttgactcttcaggtgtggaaatgaggctagtgtatagtgtaactcacaagtattactggttaatacaccacactgctagaccattttgcctttctgactcagccttacatgagtagtggattgggctctttctctctgtggggcttttctagggtcccgtatcagagaaacagtaaatagttgacagtgtaatatgtgcgtatgtgatataagccgcttaatagtttggctataaatttaatgctgttaagaatgtgcgtttaaatctgtgttaggctcaggggtcagacctctccactcagagttattgaaaatatttttaccttaaaatagggaccatggtgagattggatatgatttgagatatgctatagcgttatttttactacatttgagggagattggttatgagtgtaagtcctaggcagcctacaggtgaattatgaacttggggtttggctctagtagctcagctgttctgatttctttttaataagctcaccgcatttcacaggggaaaggactggggaagagggacacccaaaccacatgtatacactgcctcctgcacaagccccaagggatggtcactgtaaagctgggagtcccatttgaagaggcctgacattagaccagagtaactgaccttgtgcaggttccccggctgctcacatcacaggcctcctttgctccatcttcccttcccttcatcctttcatgtggggaacccttagacagtcataccacgctatcctcctcaagggcgtgaccaaaccggaagtggttagggaagtcacagactaccccgtgcgccttctcagtctacttgaggatgggactggggtttactctgagattgatgctgggtatgctcttgtatggaggcataccagtcgtctgggaagcccgatgaaattgagtgcaaacttgtgtttctaagctaaggtattcttcaagggtctgcgagcacactcctctatgtgttaggctgtttgcagggattgtcaaccctcgtttatgctgttttctgtccttgcccagcctagcttccagagtggggtaagaaggcgtgtagctgtggggatgtagtggactccctctcctttcctcacgcaaggaagaccccgcttgaggagtcacccaggatgtttccagacctccttgttgcaggcagctgtgttgtccttatgcgcttctggaagtcacatggagcaggatgagctgacatggaaagtccacttgcagaagtgggtggaattttggcctaggtgctggtactttcctgtatgtgttctgttgtttatcctctctgcagtcaccagactagacaaaggctaggcctagtggtctttacgtttctgggtctgggtaggaagatgtgtggtgtcacattggttgactccaccttaccaatactgcagagagggctggaaaaatggctagtggttaagagtccttgccgcccttgtgtaggacctggtttaggctctcactcagcacttacagttaccacccgtaactccagtaccagaggatcccgccccctcttctggcctcaggatctaggcacacgaatggcatacagatatgcattcagggaagcagtcatgcacataaagtagtaaataccaaaataaatgctgctttttaataacaagaaaacagtagtgtttgtaagctgtgcatagacgttagaattggttgttttcatttcatgtcttgaatcagaaattgaaaatatggcttcatagaaatctgtttcactgacctctgcctttaattttacagttttcttggaaatagtataattttgtttgcactagtaagcatttgcaaacaagtcttagctggatttagtacttctttcctgtaatgccagcactccaaaggcagagttggagaaggatcaggagttcaaggctggcctagctcaatctccctcccacaacacacagacacacacacatacacacacacacacacacacacacacacactcttacctttaaaatttgttgatatggaaatctgtgagcaaaggaagaggtactagttataatttagcatgtactggagcttactcagtttggcatgttggattcagaatagagtagtctagctcatgagaaaatgggtaaatagtatttattgggaacttgaaaacagatcctttcaaataatgccaggatgcgaaactaggaaatttctagttaggagttattatcattttggtttaaaatttaactgtacagttgaagtgtaactagcatgtctggacatggagtcatttctcaccctactgttttttggctgtcatggtttaggagagaagtctttgctgtggtgatcatctgagtctgaggtccttcccagagtggacatgtctttcccagtaaaagttgccattctttcagctctgtcagcattgatgactttatcttaatattgcccccttccttgcattgtttcattatctttccctcccattacaaaagagctcagccctccaccagctccacattcccagcgtggccaacgccgctttgcagttgttggcggcacagcatttgtcagttcaagacagtagagcaaagcaaacctgcacttcagccccaagacacaagttcagtgaagccattgtcgttttttactttccagtgggtgagagccagaggctggggcatgctagccacgtgctccgtccctagggttctctacgcatagtttttcccctgttcctttctggtttccttaggtggatgcacagttcatcctggctctcacatgctttcctttctgactgtgtggatctccatgacttaaaggtggccatctgttctcccaggacgcacagctttgggctcaaattcgaagtctcacattgcggctcacctttggtggccagtgacattaacaaaatactggtgcaaggatctgggtgaaatgtatggttgccgaagtgatggcttctgctcggctcctcttgtgagaaccgcgtcctgagtcactgctcttcctgcccgcccaccgagtcggtgctgctctgtcttgctgtgcacgcagctctcctgcctgttctgctcttcccttcttctggttcttttcctgttgccctgtgtgagcatttgtctttgtaaagtgaccatttggattgccctctctgggcactgggttgtgaggaagatgaggggagccaaaagctcatccaggctagccacagaatttgcctgcaatgcaaatttatcacaggcggttaggagttagctggaagaggaaccgcagctcacacagccttctcacttaagctgagaaaagtgagggcgagattggggaagtgtcatctgaagacagcttctgagaatttaaatatattaagaaagtgatttgtttcaatgactattttagagggtcagaattcctctgataggcgtcattgttggttgacagaaagctgttattaagtttatgagagaaggatgagaacatgtggtcatattttatttttggcctttgatctgtggtccccatgcatctgtttgctttccacttgggcacaagctctctgagtgacatcatgccttttgcttgaaatgtcactgcatcatatgatacttgctctcttaccatcatactgctaacactgtacatacacactagagagaagaaagctgagcaatgaccactgggcagattttccattagtactctccacattggatatatgaaaattaatagtagccagcttttttgagtacttgttactttaaacctgtctctctcacagcaatcctgtgaagtaaatactccaggaactgctgcacgtagaggtaatgaggactaggatacagagcagctatcttctctcagtctgactgggtacccacagtaactgttgctctctgtagagtgtgtgccacaaagcacatgtcaggatgtgttagcaaagaggcgggtcacgattctgaatccgctgggacaagagaatgcctggagcgagtccctgtaaaacatgtagggtagttgtgagtaactgtttgggttgaactctgagtagtgcataggagaataatcagagctgtgctggagggaaggggtgggtaaggcgcattcatatatatttacatatatatgtaaatgacaaggtcttgctatagtccaggctggttttgatatcaagatctccatccacagcttcttgagtactgggattataagcatgtaccaccacgtctgcaaggggcagatttagacatttgttctctcatacgtgggaaacactggatgagttcatgaggttctggttagattcactcttacctccgttctttgtctttctctcctgagactctggtcttcctcccagctctgtctgctaggccatgtccaagaaggaagagatcagaagcaggagtaccttgcttacttggttagttatatctgagcctggcacctctgccttcctggattccattgtgtttgaagctcctctttcttccgtctgctgggaggatggagcagtgtcatgggaagtacagggagatggaagtctgcacactcctagtgtggcctctcctgattttaagctcagtgtgttgctattccttcagatgaatttgcttcttctagttcctgagcctcagactccctagcttgccttgcatagctgcctttccagctatcccagaacttccttgtttgtaccatttcccctctgctcccttctggtctttcacatacacagtttgtgttctgtcccctttattgtcattttggggtgaatattattttcaaggtgctgggattaatactaaagttggcacatgcagggcagctctagccaagcctctaaatttttaaggaaagggaggtgttttcaaagtgggagccacattcattatctttgcctggaattttaccctcttcctaatacttactagttactgaagacaccttgggaagtggatatattcttaaagatgttgttcattagtagtagtcattaaactatgtgggaacatagtgtcatctgggtggttggctggtggctggtgagggaacaagagaatctttgaggaagatttttagcttatggggctttgtaatgattctctcttttcatgttcagagttagttgccgtcagatttactcgtaatatgttataaaagtgggcattctgtgtaaatgctgtgtacacagcacttgtttttgttctcagcacatggaggagccattcaggagagtccctgacttggatgcatgcctgtagattttagttcggttgaccttggagtcatgtaaaatctccatgtcatagcatttcgtaagcagctgtatattgtcacacagtgggaaatgtcagtgcaacaagagtttgaaaatatctactttggtgtgatttcagcgaggaggacatgtaccgtgctgcagatgaaatagaaaaggagaaagaattgctaatacatgaaagagggatatcaggtatgtgtggaactgttttgtctgtagactttcttgtcatagataactagttagatcagcacgcccgcgttcatgaaatgcggcctgtaattcctacaagtcctctcatacatccagtctcttctacacgaactactcacttggctgaaatagacgtagggaagactctgccccgcgtctctttagtctgccgtctctcagcttggctctttacatccttagaagagtttggatttgaacacattggtcattttcagttgcaagatgttttgagaagttagccgtacacttatccttgacgagggcccggtgcctctaatgactgtggcacaatgaccatgtgcttgagaacgccggccactgtgtggctctgccgtctgtagctcttccagcttgctcttctcattcctggtgtgactccaagtgaagtgtggccttcctctgcaggtcggcctgtgcagaggctgaggagagatctccacagagtgcctatgaatgaatggaactctcactgcttgtgtgattctcatgctctgcctctctattagaatggcttctgtccctgtggctaacaaaagtgttattgtaattaggatacgtacggtttggtaatggtttctgattcttcctccagagctgatccctatgaagcagcagggatgttttgtagtgaccctccttagaacttcataggatgctcagtcttcatggctgccttgctccaaatcactcggcttacatagcatcgtttgataatgctgtagaccctctgttttcctcttccacctccggggctcggttttgatttgacccaccctccctctttctttctttctttctttctttccttctttccttctttctttctttctttctttctttctttctttctttctttctttctttctctctctctctctctctctctctctctctttcctttttttttttttttttttttctcgagacagggtttctctgttcccttggctgtcctggaactcactctgtagaccaggctggccttgaactcagagatctgcctgcctctgcctcctgagtgctgggattaaaggcgtgcaccatcacctcctggctgactttcttttgtccagcattgttcccacacagtgcccaactatttagtgagtttggtgaagtgtgttttcagtctcacggtactcctcatagctcactgcccttcctcagtgtcctgtaggcgctctgcctcctccatggcagggcacagtgcttactgcgacctgtaagaaagctctcatgcttttgtaggtgaatttagctcagtgaaggctttccacaccttgacctgtccagttttgtaaatgcagttcttttggaacttataagcttatgtttgatttgggagctttcatgcaaactgaggagttgccaaaccatgtgcccctaaaaccctggtgattttctaccagacccattgtagaagaagtttgagatcccagtgctagtctgtcctgaatgttccaggttcctggaggagtcccagtttgtttcttatcctttgaggtctgattattgtatttgtcacgtatgtggtgcttgcttatctgactgcctgttttccactcttgaggtttttttttttttacttcccttacttattattgttgttgttgttattattattattattattattattttcttttcttggttttgtcaaaagaactagtcttcttccttgaagcagcaatggaagcctgtgtagtttagttagatggagggagttgtgctcagtgggctgacgaggtcaaacactgcctcctcctgtgcctccatcccctagcttagtcagcatgtgggacctgctgtgcctcccagacacagaagcctgctgggattcaggtaacattatgttgtagctatgcaagtacttaagttctccaagcctcttaccttatgctgacctctgattcaggacaggatcgggcttctggcttgttctccagcttttataagacccctgggccagccttaaccctgtgatctgagatggtaggactccccagccttgcccaggggtcagtcttagtgtgtctgcaagtgaggacagcagtggaggagacaggaaggaagacttattgtctggaagcccgtcctctgctggtgaagtaccttcttcccaggcgtacagccctccctgacaagaactgatggcccagaagggtcctgactgtgtaatagcagttcttcctgtctggggggcatgtgagtggggaggcagatacatgtgagtacttccttattctaagtagcctcctaaacattatctcttgaatttcacagagtaacagtggttgttttcatgtctaggttaatcactatgtactacacacagaactctgtctgtgcatggattatgcaaccttttgtaaaaggttgttttttttttttctttgagaaatgaacaatgaggtggtttttttgaataagcagtttttacagtttactttaaaacaaattgtactccctaaactctagggaggcttcggtgttcctgggtcagtggcttccaccatgctctggcttgtaagtgcttgtggtcctttcctcttccatctctgatgcccactggggcggagtcctggcctcattccctctcagctccattcctggcacagtgcttggcacggttagaccttcagggactatttgttgaattgagtgaaacacgtatgtacaagacatgtagactctatgtgttctaggttcatttcctaaaacaattgctaatatctctatcctcaaaagttttaaaaaggagccaagatgaacctgaaaattgcctaatttctttttgaaatcacaaattgtcatatgcatacatatacataatcataggcatatatcaagaaatcaaacctcatccactaaatcaagaaagtcttactgaaggccctaaattcaatccccagtacgcgcacacacacacacacacacacacacacacacacacacacacacacacacgaacagaggagaagggatattagggagagaagtgactttaaaggcattttttataaacaacaacaacaaaaatctataacatgtgtttaatcctgagttgtactagtttgggggagacatttaaaggatgtctgtggattagccaacactgagtgctctgatcctttctggtttataacaaaaactataatattaggtaaatagcaaatggaatttttgttaggtgttatctctgtctaatagatatgaaacaaatgatgagctatttttcatggttcctatgcctgcatctgattattaaagtgtacacacacacacacccgtgggtcaggtgagtgagagcctggaggttcctgcagctctctgaggctgtgaggaaggactgcctcctgactctggagttaatgagcaacctgactggtgtgtggagtgcaggctgtgtggtgtggtgacgagggagacccattaagagagcactctggtttatagaggtggcatgggctgaacgcatgggcagtagtgagattgaggaatttttaaactagagaaagtaaggtgtaaggagaggactccctcccctaggaaggcagtgtctctatttccattactcttgctttcgttgcttatgtgtttcatttcattgttgccattttgatttttcaacagaacccaggttaagtgtggctcctgaaatggatatcatggactactgcaaaaaagaatggagaggaaatactcagaaagccacatgtatgaaaaaggtatggccagggtgtacccattgaaggtcttcaaaccgtctgtcctgagctacgtatcataggatgcttttagacagtggttaggacaactgctataataagacaatgctgtaaatattggtgttctaattttagagatgaggaaacagactgcaaagataaggacttgtttggagtcatagtactaatatagaagcaacatcagttctttagtaacttaatttctttgaagaacacagagctgtgctgttgagagtagactcagccactgctgcttctctttgagacagttgtgaatgctcttcttaactggtgctgtaaaggcctcaaggataggcagaggcgattttacacctctgcccatgcgtctaagtcctaggtatagattcctcctgtactttctctgcagaggaatttgaaccatttccttcatttaaggtgtgccaggagctgccttcacttcattctgttgtatactagcactcctagactagcctctgagactgataggtattggaactgcagtacgccctgtgggctctgcttacagagtgcactccatctgtctttccttatcagtaagggaaaccatgtgacactgtttctgtttgaccgttcctaagctagtggtaaacttctacctactacttaagcttgtgtcttttgattcctttttttttttctttcttggattatttatattttgaatatactacttgtgctttagaaatactgaccagtcttttgtatttttataatttatttgtatgtatatgggtgttttgcctccatgcatatctgtattatgtgtgtgcagtgtctgcgaggccagaagagagcactggactccctaagactggagttacctatgattgtgagcctccatgtggatgcttagagtggagcccaggccttctggaagagcagccagtgctcttaactatggtagaattggatagaatcatattgaaaagggttttaaattctttaaattttaatttctctcatagcagcagcagaagctgcttcttctcccccctccttcctcctcctcctcattatcatcattattattattttagaaacttactcgtctttagagttcaactcatgtcttcaatctgaaagatgtccaccttagccctaattcttacaaacctgtgttctaggcccttctgtgtggcctcagtcacagaataccctgctttctggttcctgctaaaggtgacaggcctgttttctcagaggccgtctgcagccgggcttccatccactctgggtctcccgctctccacccagactctgcagggagtcacatccgtatttccttacctgctctaggaaaggcttcactaactaatgatttcattctgttgtcttagtctcttccagagatcagatctgttttaatgtggcatgtctaagtccaatactgaagacactcagttacctagatatgccatattttagaacttatgggaaaatcatttctctatgggcttgcacgcaaagaaaggtttgaccattcagtaatcagattaaaacaccccatttagcggtgcagctccttagcaatctgagcattgcctgttataaactttgagtcttgattttattttagttcttatttgcctaattacctgtgtttcgattcggatattcttttggaagtgtttataaatccagaataattttttttttcgagacagggtttctctgtgcagtcctggctgtcctggaactcactctatagaccaggctggcctcaaactcagaaatccacctgcctctgcctctcaagtgctgggattacaggcgtgcgccaccactgggccagattaattttttaaagtgttaggttcatctcttaaatagtacagttacagatctgtaggattaaaatggacctgcagcttttggatctcctgatgacatagctgtgatgtgtgtgtgtgtgtgtgtgtgtgtgtgtttgtgtttgtggtgcatcactctagtgcttgtcatgaggctgttataaacagacctggactgtcagtgaaagtgctgtgcatgcagtcatgtcatcactgcacgtgatagctacccatgccacggctctgtgtacaacgtgtgccctgctgtgtcagcagcaacctgatacatcatctcatgttcactttacctcttgattgtggtgttgtgtcatacttgatttagtacctttgttttccattgtggcttcttagcatacttcccctgctaatactcagtaagagcctgatagtcccaggatatagtaggatataccagctaggtttgtgcacgtgtactcagatgtgtgcacaatgatgacgttgcctagtgacatattctcagagtgtattacctttgctgagtgacttctgcctgtatgtgtacacacacactttggaaactcgggatttatggacatttttaaaactggagatagaaatattgcataccccccttcctggtctctttattaaagcatttgggaaaattaaccacagattaaaccgttcgggatgtgagcagtgagtgagggctccctcagatgactgggaagggactctgagggtgcatagagctggacagctggtttattttggatgtcaggtctgttgcatttgttatagatcagtggtttcaacctgtgggtcacaactcccttgggggtcccatactagatatcctgcatatcagatatttacattacagtttacaacagtagcaaaatgacagctatgaagtaacaaggaaataattttgtggttgggggtcaccatatgaagagctgtgttaaagagtcatagcattaggaaggttaaggagcactgttgcagatgctgagatttcataaagaaagcatcagtattttaaggtaaattgaattgtaatcagagattggaatgccttactaagctatcctttcttgtttgccatttcccaatgttttaggacaattttttcccgtagggatggaacttttcttgctatctcaagccagtaactaccatctaaactctttgatgttttctcccaagggctatgaggaagtgtctcagaaattcacttccataaggcgagtccgtggtgataactactgtgcactgagggccacactgttccaggccatgagccagctggccgagctgcccccctggctgcaggacttggagctcatactggtatgttgttgcatgaatttgaatcacagtgtttcaggaagttcttctcagaagacttctcctttctgctcatgttgcctgaaggtgttacatgcagtgtgatttcagcatatggatttgttcagtttgcatctgtaagatgatcttatatgtataaaaaatgactagaaataatcagtattttcaagaagagaaagaatgacaaaacttaatacacttaagctgagttaaagaccagatgtttagaattcataaaaaacacatagaaaaaaacttgactttattttagtgtttctctgaagtaagttatataatttttactggagttcatgtggattttaggggcagttcaaaaacaaatatacgtttcatgatgagatgctagtgttacgtagagaaaccttttctggacctgactatccttagtgctttatttaagtcatgggagagagtccctgggatctatgcctgcaggtgtcttgatacaaagaaggcctcatgctgatgatttgtgtagcggataaaaggaaattctgtaaaccctggcgctagtgaacgcggctttgctattttctgttggctcgggagttgaagggctttgggtggctgagggtggacaatcttaactgcagctcgggctgacttcaaacctgtggcaatcctcctgcttcagtctcgtgagtgctgggattactggtgtgatagacacatggcaaagctgttacttctgtgtggtgtctgctgcgctcctgtgttagagagtagctaacttgttcccgtgacactgggcttcttacacagcatggactgtgtgctttaacacaccagtaaagggaatgaatgtgttttacaacttactaaagaaagaaatggaaattttaatttatttttagatggtattattctgagaggatagactcggcctacagtactcttaaaaacaaaagaaagcactttgaaaattattacgaaatctgatacttttgagtcttttcctttgtgggcctttttagatttctgggcttatttgacactaattttaaatttttatattttctaagaatttttggtgcaaatacagtcctaagtagttaaacatacacattgtatcccagaaaagtaaagcaacggctcctgctaacaggtgcattcgggttacatcacctaccccatgtgaaatgggtcagctgttgcatgcctggaactgcagcactttcatgctgaggcaagagtcctgtgacatttaagctgctctgggttatgtagtgcagccttttctcaggagtgttggcttgcatttggtcttggacagtatgaaaatgtgtcactggcaggagtgatgaggtgatggagaggtcttcctggcctactggagtgatgcacagagaactgttaaattcccagtgggctcctcttttccatagcattgcatgtttgccttccgagggccccgtcgctgagatcagtattcacactgattggattttgcttctgctcaatatctgctgaagaaactactttcctgctcatgccctcagaaacgtaacatggtttggacctttcttgacagtttgttgtatgttcctaagacttgagtgaaacacttgcctccagctctgcgtttgaggagcagggtgggggggagnnnnnnnnnnnnnnnnnnnnagggaggagaggtagacaccacaggtactggagagtcactgactgagcaagggtgctagctgtctgcttccatgtgcagactgtgagcccagtgccgctagagcttcagagggagactaggcacagttagtgctcagacggctgtgcttgcttgagaatgactcctgggcagggccttctgctctgctctgctcagtctctctgcctagctgctctcctgcttaggagttgagctctgtcccttttgatgtgcagctgtccccttttctcttgtcctgcctaggctttctgattgttcttacttctgtccagaaccagcccgtttgactgcaggcagatcgtctgaccctagccccaacctggacatagctggccaaagctggatcagcccctcacttgtgaaaagggagtatcctttctattaggagctttttagttcttaagtgcactgtatttgtaaacatctgtgaatggataagacctgtgacagcacttactacagaatgacccgaaagctccttgtgacttcattttgaggttgatgcttttgatacatgcagttgccatgttatcaagattatagatatttgttagagaaaacaggctgggctctaggccagtcacagataatgtgcttaagctaccgagtgatccttaaccgttaccatcgtcatttcttgcttcagtctccttcctcctcttctcttgctatctttagttttcttttttccaagacagttttctctgtaatcctggctgttctagaacttgctctggagactaagctgacttcaaatgcacggtctgcttcttgcttgctcttactccaaaagaaggcagacttgtgtgcctactagaaaggaatagtgatttatgtggaccccatgtgtgacccatgagagcatttaaagttgtattaacttctgaataaataagtccaactccatgttctttcctaatagttcttctaaacttttattatcatgtgtctgtgtgagtgtgtgtgtgtgtgagtgagcctgtgtgtgtatgtaagtgagcctgtgtgtgtgtgactgagagtgtgtgtgtgtgagtgagcatgtgtgtgtgtatgtatgtgagtgtgtgtgtgtgagtgagcgtgagtgtgtgtgtgtatgtgagtgagcatgtgtgtgtgtgtgtgtgtgtgtgtgtgtctgcctgcctgccacagtgagtgtacggagaggtctgaggacagcattgtggagtttactcaccatctgtgcttacgtgggctcctgggattgaactctggacagcaggtttacatggtcagtgctttctccacagagctgtcttgttggtcctctaccttggtttcttttctaagtctcattttttttaacttttttctaagatttccacgctggacctggataatcacttaatcaacagactgaccaatgagtgactgagatgagcaaactaacttgtttctaccaaaagtaactgagttgcctgttgtacttgctccttaggttactgtccagtgctacagagccacagctcttcccgggctgccacctgcctcctctcagaccttatagctttggaggagtattttctcttgagttgtacttcttggagccagggtgtaatttcatgttgctgccacttgagggcacatgaggttctggtgataagtctgagactaattaaactgcctgtgcatgtctcacaagtgcagggcttgtgggaacagtggggctgttgcagctttaggtgaaaggtcatttatcacagtacaatacgatgactcgatggcttttccgcttgactgacatagagcactgtcactgtgattttgagttttgtagagacaagtcatcttagttacatatgattgccgtagactgagaaagcacaatcagaattattgtttatgaaggcgtctcagaggcttaggttctagtggaactgagcatgctctgttctgaactgcctattactgttaagcaagttcagcacacggtgttaggataggattctgactccagggatgaaatctctcttttatagtgccagttacccctatttatttatttgttcctccctccctcccttccttccttccttccttccttccttccttccttccttccttcatgtacgtgtgtgtgtgtgtgtgtgtgtctgtgtctctgtgtgtgtgtgtgtctgtgtgtgtgtgtgtctgtgtgtacctctgttgcggaaccatctcagtggacctcaggtgaaatcttagcagtgtagtctatggttttcatcctgacacacccaggactcttgagaagatagagtttctcatgatgtcatggcttgaattgtggccttcagattccagattctaatgctgtgtagggacaaatgaaatagtccaggaacaggaacagaacgtgagggccatagtagttgcctgtggctctcattagaaaggtgctgctcccaccctcccgctgctgtgggcctcattcctcttccccatcttgtgctgtggattaaggatgtgtgggaaggttgtcaggagttacgcttcactgtcaggaagagcagcagcctttgactctaccgtggaccttccgtgcctgcagtcaccttgctgagccatgtaatgtatggtaaggttgccgtagtccccagcagccacaggcagtgaggaccgctgtgaagacccagtgtggattcttccttagcttagcctcagatctgcgccttgcctgtccttgcctgtgttagttctgcaggctggactcctgtagatttgaaccaacagcatttaaccttgcagccttctctgtggctatgctttgagattgtgacttccatattcagattctccatcctcaacccatatgatcctctcgcaggaattaatttttgaaataaggtaggttttgtatgaaggctttgtggtgtcttccttttcggttgtctcagctatctggcaacactgacacttctttatctctgtttcttgatattccagttaccagagaagctgataaacaagtatacctggatcaagcagtggaaacttggactgaaatttgatgggaagagtgaggacctggttgaaaaaattaaggaatcccttgccctgctaaggaagaaggtttgacgcacgaaattttctgtgtctgatcggggtgcaaagctttctcttttgttgtcccagcagattcagtgttctaatcttatttatttactcatatttatttttaagtttataaggaagaaggttcattttagctcatggtcttcattaggggtcagaatttgctggtttgagacaaaataattttgggctgggggaactgtgcagtctgtaggtgcatgacagggaactgagtttggttcttcagaacttatataaaactggtggcatgtgattgccaccccagcaatggagagcaggggacaagagggtccctgagggtcactggccatccagtctagcctaactaatcagtgacagtcaccatatgcacgcatatacacgtacattcttacacatgtgtacagtcaccatatgcatgcatatacacgtatacccttacacatgtgcacagtcaccatatgcatgcatatacacgtatacccttacacatgtgcacagtcaccatatgcatgcatatacacgtatacccttacacatgtgcacagtcaccatatgcacacatatacacgtacacccttacacatatgcacacacatacttacacacacattgaaaaaggaaactttaaaagaacattaattcctctcattttttggggggtaaaatggaaaaacaccaacattctattttcttggaggtgatgctatctacaagtgtctcagataacatttaattttcttccaaagaaaccttaataaataaaatttttattttaagtcatatttgtaggttttagggttatcatttaatccacattccttttaaaaagattgattgattgattgtgtggtgtacgtgtatgtgcacacatgtgcactgggtacctgtggatgccagaagagtgtgttggtttcctggggctggaggtgcaggggttgtgagcaccggcatgggcattatctgggagagcagcaagtgctcttagccgggagctgtggctcctgtcctttatcccacgttcatattctcagtgtatctctgtgtatttattaaggtctttccaggtattcttacattttaaaagtctatcaatacgtgctataaaatctttctcaataaatagatgtagcaactttggaaaccatcctaagagtagtctgaaataattcacgggattagttcacggatagcttggtcttctaatttcctgtgggctggtgaatacaagtctccttcctgtggtagagggcactgtgttccccttgcctattggagtgtaatgcttaggggctagaagccactggcctgctggcgtgatgaaggcaggctgcagctctttgaaggacagactggcaagtttgtcagcttagttgtaaggtgtagttttcttttcaggttttgtaaggggctggtgagggtgttagtttttttgttttgttttgttttttgtaaattttatctctctctctctctctctctctctctctctctctctctctctctctccctctctctctctctccctctctctctctattattatgtatgtcaactgtagttagaccctcctctgggggaatgtgtatatgatgccaatttacagtgacattaaaattgccagtaatccatgtgggcagctgtcagcacttctcgttgtcacacttggcactaagagttgcttgggttcctctacctttcaaccaagaaagtgggatggctgtggtcatctctgttctaaagataagggaactgcagcctggagggaaaccttgaaaaaccacatcttaattgcatacttgagtctctgactctatagagtcgtgcttgtagccagcaccattgtctgcttctagaaaatatgagacatgacaccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagttatgtttttatgtgtgttaattatgtgaaccttgatttttttaattagtagtcaataattcctgattggaatttattggttagatcctcatgtatatttttaagacactatggggtaagtttaataaacccatagtcaggagacccccacagtcttggttggcagtcttccagtttggaagtctgtgtttatgggttttctaaccctccaggtgtagcacttccagctgtttgacagctctcacacaggctctgttagctgtctggttgtgggtgttgcccttgtggcttggaaggctgaggatcagcatccgtgtcacatccccatacctccccttgctgggtcgcacttcacattaacaagagaagcagctaagcaagggctccatggagtctgaggaacactgttgtctgaggtgagagagcttgaagctgctcacattggcatgttgcttacggttccttcttttggaaaccatcttgtaatcatggtacagaagtatgaagtatgccagggatcctcagaacagaaactctaatggggacacctttgttattgtagtgggtaagcctggctgcaatgaaaactgctgaagcgaggcagacagcttgtgatgagctgttcaccaacgaagaggaggagtacagcctctacgaagctgtgaagttcctgatgttaaacagagccatcgaactgtacgatgacaaggagaagggaaaggaagtgccgttcttctctgtgctcttgtttgcccgagacacatccaatgaccctgaacagctcctgaggaaccacctaaaccaggtgggacacacggggggccttgagcaggtgagttgtggctttgagagtatcttacccctaggccagccatcaaggggtcctagaacttgtaggtgagttcaggaataacctgtctgggtgcttctggtccagcacttcctgagcttgcagccagggcattgaaggctacagtatggatggggtggaggatttcctgcatgtctcaattgcatacctctttgttggtggccagaggggtcattcagttcctcactgtataggcctctcctcaggtctgctcttggtttgttagaagctacatattctcatttatcctgtattctattttttataagctactcactaaatctgttacttactcaagggggtagtgaagttctacctttttaaggaagacatttctaagacttatggacataatttattagtctcacccttacatggtcctaggattgcttttgcaaagtgatggataagattagttctcttgcctctcttggatgctaatataatttgtaaaatatgttgttagcactctgtgtgcgtgcttgtgattagctaccaactaaagtgaccttaagactctggatctaacctgctgctttctacttgggctcctgtgcctaccttttcctgaaaaggcccgagtaccaggacagatgcttcaagaaatagagagccaagttgggtttctatgagtctttctggcagatagaaatctatgaaacctattctgttgttttgcttaaggagtaagaaagagcaaacgactggtggttattgctaggtcagaaatatttatgattacttaagataagtctttgtacttagaatgtagactgcttgactcctgaactgtagtaaaggtcttgtggcaaagagtctaggaggacttgcgctatacactagactgaaattagtccgttctaagactgcaacagtatgcaagctctgctgcaatggagaatcctctttaaaaatagctcctttaaaaatactacttaatcaccattaacccatccctttaaaccaccagtatagtcttaaaccatgttggatctccataatgaaattcaaagctcgttagtgatcaggcttcctttttttcaaccttaggcagttgtactctgatttctgggtatagattgcctgttctggacattcttggaagtggaatcatacgttatgtggtattttataaccaccattttgatttagcataatgccttaggacccatctacgttttagaatgttctgggactccctttttcttaccaggtaaagtggcattgtgtgacagtgtcctgttgtgtgcactcatgtgcttgatgtgtttgggtagttcttgctgaccgctgtgaacattcattggcagggttgtgtgtacatgtgtacgaggttcgtattgggtatatgtccaagaacggaactgctggggcagatggtagtgttgtgacgttttgaagaccactatacaggtctagagtgtatctcagtgtcagacacttgcatagcatggacgaggcctatgtttgattccttgcatcaccaaaagaagaatagagaagcagctgtcccactttatactcccacacttcatcacttttccatgtcttcatgatgctttcgctatcttttaaaaactcagggacgttcagaacatagaccagccgtttaactgtgtgatgaattaattaacgtttaggatgttctcagtctccatacgtttcattactcccaagggaaacccctcattcacggtcactcctctgtctttgattgtatacattctcacaggtatgatgtattcgtggcttggctttgctctcctctaagggcttatgacttaatgtggtcatcggccactcatttatcgtctttggagaaatgtcttccaaatactttgttcaattttaaactgatgtcttattgtatactttattaaattaacattaaattttttatgttccaaatataagtcccttttggatatgtactccattctttattatccttcttgactaggttcagaggggaggagactgtttgcagctaagctgttgccactcattgtctgggatagtgggtgcagctcggtgttgggccatctttgcccgtggcttccctcagaacactcatttgcttttccttcccaggttgagatgttccttcttgcctatgctgtccgccacagcatccgggtgtaccggctgtccaagtataacacagaggagttcatcacagtctaccccactgatccccccaaggactggccaatggtgaccctcatagctgaggatgatcggcactataacatccctgtcagagtgtgtgaggagaccagtgtgtgagggacacacatgtgactgccaagagatgcgcatgtgcagctcctcctctgggggcctcagatctgcaggtctccaaggacaatctgggagaactctcgggcccctggagccaactttggaccattatgttctgaagactagctgttgataatgagaattaattagccaagccttcactccttgttctgttatgcagtgtgttccactgggggcttcagcacgtgcctttggaaggtgcaaactatgtctccataaggcggatgcttttgggtcaaagaaaactgtttggaaagggaatctgtccaatgaaagttctgacggtaaactggttttacttctctttttaaaacagtagttttgtatttgatttttattccctttttgggggggaatggtggtgatggctctcattcatggtcttcctatgagatatgcttaaatggtagtgtcctggaatgagtagttacaatatcttttgatagcctcatctgcttttggagggatgagcaatatgccaattactatattttaagtagattgtcttagaagacaaagaatggggtccggctggaagaggttcagaagaaagtgtggaggagtctagacttcatttgctgaggctttgtgccctggcattgggagatcctctttgcacacgtgctctagtgttggggttgtgggtttcagtgattccagtgtcactcaagttcagaggtgggtgccccttttcctgctgttgatgatgctgtgtactgccgagcccatgtaactcatcctgtgacaggatgtaacacagccagctatctgggatgtctgctaagcaagtcagagcagaggtgtgtgctaagcagtccaacctgtgatggagctgctctgcagctaggaggcagacaggccagccagggtaggcataagccatgctcctgacttgggcaagggggactggggagatgttctcaacgtggcttgccttggggcctttatttcccttaggggacatagcctgtgacctttgttcatggggaccagacacatgcttctttagggttccatcgtagcacctgaatcagttaaacatttgttggtggtgttatcctgattttgaactgattttatgatagttcaaattcttaatttgactccctttcatagagacgataagcaattaagtcttatgtatgaaaactcaggatataaaaagcaatcaggccttggtaatatttcttgcattgcctcatgagtaaaatcaccacatttcattaactgtttattgaatagagtgctggcatccaatgctgttctgaatgtgtgtgactatgttgagaggcattgtgctgtcactgtgaccacctacctgaggaggccccgagcagtagttaaaataggaatagtgacttatcgtggactttgacactttatgttgttccttgttgctaaatagtgggcaatgtctgccattcatgtttaacagttttggaagcagaacttgaaatgtttagataattcccagcaggagtgatctctgccctttgaagctgaccactgggcttgtatcactgttgaagtttagtaatgctcttggtaacaccatggttatctgcattttaaagacaatgcgaccttagtgaacttgagctgctttctttatatttcattcttctttcttcttcttgtctgtgataatgttaggtacagtttccctgtgttatatcccaagtcagagcttcttgcaaacctgcactagattgtgtatgtacaatacccatgggctcactcatgcatgcgttcgtgatggcagcattagtgcctttcacttagactttgggtctgtgtgaatttgctctgagatagttgcactcatcccgttctcctgtacagccacagacgctgtcattatcctacagagtaggaatgacttaggagctttttcttgaaggaagatggcttgtccttttgtttatttttccttccaatcttaggacttatcaagtaaaatctcatacaatatgaattgataaggcttctgttggcaggatgtctggatttttgttttgtttttaattgagttgattggttttgactttttgagacctggccatctcggactttgacctgagtgctgtgattacaggtatgcgccactacactagacgagttctcactgtgcgcttgtgagctcttatgtgttgaagccttgttcttttgattccctaagtgactttgtgcaatcttcctgtcccctcccactcaccctgtgaaacagtggtcttgtttttgaaggtcttttcgatgtttctgaggtgacagcactaatgatgaacctctaatggtggacacatgcaggctgccatacttcctgccatgtcatcttctgtgtaaagatttagttgatcagtttccttatttatttatctatcttcttaagtattactttgtgggtattcccctttatatatattctgaagggcagaaaatattttagaagcaaaaaccattgaagaatcttgcttgtggatgtataaaatagatagtgttgctttaagatgtattgtttctttaaaaagcaataaccacagtaaaaatagaaacccttcaatgtgtgcagttcatctcagagaaacaccagatcaccaggttggcagaggcagagcacagtgtcaacttttaagaaagtgataaactgtgaggggtgaggtaaaaggtaaggttaaaactctcagatgatgtatagcttcatttctttttctgttactataataaaagtctcagacagaagcaacttaagggaaaagggtttttagctcactgatcaaggatgtccaccatggcaggcaagtcaggagcagagagcagtgagtgcaagctcctgcctggttcctttgtctctatatacagtccagcatcccagccaggacaaggtgctgccactggaggcaggcgcacccaagacattcatttcccgtggaagtctagttctcttaagctggcagctaccactgactgccacaccataccatgcagtggatgcccaacagacctgtgcttaaatggaaaagaggaaaactctgagtgaatgtgaaaggttaatgagaacatagtctatcaattcctgtccccaattttaagtccattattttaaaataggtgtaatatttaacatttaactttttaaaaatctcgttttcatatctttggaggaacagggggaatctggttttagctgtgcagcagtttcatgaatgtgtgaagtaaagagagacattcatgaaccacggaaggcaccacggtcactggtttagtgtatagttgtccaccctcctgctggtttccccaagtcagtaatactaggagccaggagggatagactctgcttgtgtctgtgttgggtcggggtgagcgtgcacagcagcctgcagtgtccatacagcatgcctttgtgcacatgccctgtagctgcacagcttgggaactcaccattccgagaggatggaggcaaactgatcaggtagctgtgtaaactgacaacttgctattggagaagatggaatgaagcatatttttaattccacatagaatgaccttcaagtgttcaccgttcattggattgactgtcacatctaggtcatctcttagatgtcctcctacagtgtgactactctaagagcacgctggagtagtcacgctgactgttagttaggagcactgactgaggaagacactgacctgggttcttccaggtttatctcagttaattaacatcttgctatcttgggtttaggtttgcatcaggaattaaatcgtcaaaactttagttagtcaagaaaagagcattgagctcaaaagatccagtctttatcatcattttcctaataaccatgggtacttgagtcttaatgttgaccctcaaaatgcatttttgtgattagttaaaactaggagaatccccttgatctgcattcccataagtggtgctaaaactctggtagtcagtcctacgagagaccacagcagccatcagaggctgcgactcgaggttccccgggggagtgcaggcaatgaacttcgtttcctttctgctctgcctatggaaggcctttggccttgtcacctgcagcttagtaccttggggaggatggcagcccagttttagattctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccctcccctccccggggttcatcatgatgggcgattgcactatgacctcgctgtgctcttgctgccttgagtagcagagcctgctctaatctcaccaggacatggcagccttggtcagatgctcactgccctgaaagcataaccttgcgatgtgggcgctttggggtcttgcgtcccactgtgaactcatctcagatgcctggctggtgcggtgagagtctcctgtcgtctgtagtgtctctcgtcttcaaggtctttcaaggtcagaggctgagcctactctgggtctttgcttctgatccctttaacatactcagatgcgaaggattatggaaagaactaaaaataaacttagaaaataaaacttagaagcttgttctgctgctgcagttaaatgtctacttttaaggactgtgacagactgagacccacatgttaactttgtagcatcccattgtaggcctgtgttgtcctgagacccactctgacatcttctgcctctgtgggtagaggggttaggatttggtgtgttgttggtagctgaagttagtcgagatgatgtgaccagcacagcacctaaaggtgtatacgctgggctgtgggtctaggttgaaggacagttctactacctactctaagcatgatgagctgggcttaagtaagttactgaccctccctaaaatcgttctttatctcagtcgtgcagtccttctcaggtgtggtgtggatggcatgcctcagatttggagaaagacgccctctgcctgcaaaacaggcttccaacaacagtcctggtgagtttgctgaggagagagagacctgctgtgcacagaacagcttgcttttgttccagctgctggaaatgcacctggaaggtggatagcaaggacttgtgtggggctctcacagacagaaggtaggtagtggagaccaggaaatgacttttttcatgcctcctgacgtataggaatggagaaaggggctggagagatggctcagtggttaagtggttaagagcactgactgctcttctgaaggtcctgacttcaaatcccagcaaccacatggtggctcacaactatctgtaatgagatctgatctgatgccctcttctgatgtgtctgaagacagctactgtgtacttagatacaataataaataaatcttaaaaaaaaaaaaagaaggaatggagaaaggacaagctccagtggcgatcttgtgtagccgaggaacaagtaggttttatagtttttcagaaggcatgagcagtgctatgtgctaatggggaacaagacaaacaaaaagaatgacaagagtattactcaatctcctgagtacgagagtgctataactcgctgctgagctctgcctctctaaagttggaatctgaggaaggagatggagccagggatcttaacttacatgtactgccctaaaccagcctcattccctgggctagaccaaggcttagctcacggtctcctgttggaatgcattcagagatccctctatccctcaccttgttcacagttcagggtgtctcatcaactgctagacagggagggatgtcatggaaatgggcgagaggtgcaaatttaccctgtggtgcctgccattcttccccaaggaaagccactgttacttgggccagcgcatctctgtattgcctttaggataggtagccaggtgactaagctcaccttgatgctagccagatatgaagatgcctatatcccacataccttggtggaaacaaagaacttgacctcctaaggtttcacaaatgcaatgggcatgatgataagtatgtataatcagcatatggaaagtggaggcaggaggattatgagtctcaggccatctttggctagttagactatttcaaaaggcaaaacaataaagcaaggaaaactcccaacataagcagaatagatgtaatcaaaagaccaggaaggaagaaacctccagtcttaaagtggtgggatggtcgtaaccatagggattatgggtctgtgatattaataaaacaacaaaacacgaggaatttgaacaactaatcttttgggttataatggcacatcttgaaaagcagggctttcctgggaaagtctgcaggcagggctacagatggtaggagttacagactcttctcagacctggctgacattgggatttccatattctgagcggggcagagaagctggggaaggctcaaagaagactatgcccaaagtggtaggaagtaaaaagcaccataatgcagaaaaacaatgtaaagaataagttatttagctaccacaagaagtttggaggaagaaaaccgctcgctcacctagattttagctactgagggtaaagggctaaacttaatatgtaaatctgggaaacggggagatcttagtgaaggttaggaaatgaagcgactggtgagtaaaagactggttaggataagaggaccaagacactgagaacagcctcacttaaccagcccctcatcacttcttagacacaaagctggagtgtgcagcctgctcagcggtattccgggtaaaatcccccaagcctcacaccaaaaacacgcggatgctagtagcaacaaaaccataggcaggactgtcgaaatggcttctatatggacttccttaggacaggattcagccaggaaatggaaccgacagctgctgcacatgtgcaggaataacttccagagggcttcgtttcaccaacgcagcagggaaatgcgggttgccgttaacgctctgaacttgctcattttcattgtgttctaaaactggttcatatataaaatcagcgttgcacccggaaggagcctggactatttgagtgggcagtgcccagaagcgagaggtgtgaaaggccctgtcataggcccggggttggagagctctcttgtgtggcagtcaggtctttgaagctctgacactttagtcctaccagctatagacagtcatcttaagataccacatagcaaagcaaaatatcattgattaactacaaggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcttatactgcagggaaccaaagtcgacctggcctaatgttctcccgttgcaaaagctgcctgtcttggacccacggttggaaacctgtgttttgggcttttatagcaatcaccactgtgcatgacacaggatttctgtgaagttatacacaattcatactgagtagggtgtaggaatgggttcttcccccccccccccggtcattaaagaattaaaaggcaggagagtttgaaagtcaaaaccacagtttatttgacatacaaggacctggaggaaccctcttggggttcttagtctcattaagagttttattaaaacatcaaatggaagctcaaggataattttagaagagttttaaaagaaaaatcccagagcaagcaagctgtaagtgtcgggagttgcctagaggagagaggggaagaaggaaaaaccatgttactctgcagcaggcagccacgtggtgggaagggagcgttcaggataaagcaaggaacccccagctgctaggaacccccagctgctagagaaagcatacttgggaacaaaaaagggaaggagtcggaccttttggcatagggagcaagctgagctccatggcagcttgggctcgggcataggaattctggggagcaaaagtatctccttaaaggaatttattttgcctatctcttcaacaaggctgaagttgagtctgcctccctaaaggtgctcccacctccctgctgtggtcccttggcccggtggttgacctgctgggtcacattcactcctcatgttggataacttagtgttcgatttttgcccagaccagagattttttaccctcttgagcagaaggaagagttttctcttagtgagtcctcacggctgctgggttggagcagttctgctctcatcccctctctccttgtacactaaggacttctttttcaagtagaaaggctttcggttcttgtctgtggtctcagcttgtatattggttgacattgtttgtacagaagtagatgtcaagtcttgctaataagtgcatttggagttactggcccaggtgaaaagaggtactgtataaaagctaactctgtccatgtgtgtctcctgcataaaccatccagtaagtctatccacgtgtgtctgacagtcacctctaaaagcgcatctccctagtcaggttttgagagaccctgtttgattgattgcaaatgcaggagagaaagattatcattggacggaaaggcagcttagtgattcagaaggtttgctgtgaaatcacaaggatgagagttctgctcccagcatccacttagtaagccccagggggcatggggggtgtcaaaggccagattcgtgggtcttgatggcttctaagggcctccatctcaaaggagataagactactactcgacaggacacttggtccctcttctggactctgttgtgtgcacagtttgtgaatctccacactaaagtgtatatacgcaaagatacacactaagtagaaattctgaaaatgaattactaagtttttgtaaggtactagttacaagtctggcaccacttgcacttggcagagaatttgtttccttggatttaggtgctcttcctggtagggcaccacatcagttaacggagctaacgaccacccttctgtcttgtggtggggagaatgaaacttaaggtttccttgtcttctcattattttcccctttgagatcagacagtaaacaatgcagtgagttgtttcctgacttgtaaagtggggttcgggttgttgattacagtcctgtttgcctcttgtttagctttggtgtgttaattttagtcaccagcctttgagcagggcacccaggcctttcttgagatttccactacatcctgtttcatgtgtggttagatcagctgatgagtcacctgatgttttgccacttcgaatgacaaaaatagaggctcagaataaccacacagagaagcagctctcatggtttccagatacattgctgaaaaccgtgctttttgatgcttcaagctttttataaaagagccttgtgtgaggctcttgtggaaaggcagacaagacactgggtttgcacagctaacactgaagtcacctcaccttcccaggtcccaccagagatagcattattatacttttggttataaaagtgtgtgacaggcagcattgaaaacaaccctctcctggtggagcacagaaggcttagcttgcctgcagtaccctaaaccagacacaaagcagcacatggtgttctggtcatgttctattcagagctttactgaagcagaaaaaagtacaaggaaacattgctcaggtaacatcatttcattagaagaggccaggtgtggtggtgcacacctttaatcccagcacttgggaagcagagccacatggatctccgtgcgttcaaggtcatcctggtccacatagagtcccaggacagccagggatatgtagagtgaccctgtctcaaactaaaaatagataattataagaatattaggatttcctattt

SEQ ID NO: 2042 - DNA, 908 bp, Mus musculus
gcgaggaggacatgtaccgtgctgcagatgaaatagaaaaggagaaagaattgctaatacatgaaagagggatatcagaacccaggttaagtgtggctcctgaaatggatatcatggactactgcaaaaaagaatggagaggaaatactcagaaagccacatgtatgaaaaagggctatgaggaagtgtctcagaaattcacttccataaggcgagtccgtggtgataactactgtgcactgagggccacactgttccaggccatgagccagctggccgagctgcccccctggctgcaggacttggagctcatactgttaccagagaagctgataaacaagtatacctggatcaagcagtggaaacttggactgaaatttgatgggaagagtgaggacctggttgaaaaaattaaggaatcccttgccctgctaaggaagaagtgggtaagcctggctgcaatgaaaactgctgaagcgaggcagacagcttgtgatgagctgttcaccaacgaagaggaggagtacagcctctacgaagctgtgaagttcctgatgttaaacagagccatcgaactgtacgatgacaaggagaagggaaaggaagtgccgttcttctctgtgctcttgtttgcccgagacacatccaatgaccctgaacagctcctgaggaaccacctaaaccaggtgggacacacggggggccttgagcaggttgagatgttccttcttgcctatgctgtccgccacagcatccgggtgtaccggctgtccaagtataacacagaggagttcatcacagtctaccccactgatccccccaaggactggccaatggtgaccctcatagctgaggatgatcggcactataacatccctgtcagagtgtgtgaggagaccagtgtgtga

SEQ ID NO: 2043 - protein, 301 aa, Mus musculus
EEDMYRAADEIEKEKELLIHERGISEPRLSVAPEMDIMDYCKKEWRGNTQKATCMKKGYEEVSQKFTSIRRVRGDNYCALRATLFQAMSQLAELPPWLQDLELILLPEKLINKYTWIKQWKLGLKFDGKSEDLVEKIKESLALLRKKWVSLAAMKTAEARQTACDELFTNEEEEYSLYEAVKFLMLNRAIELYDDKEKGKEVPFFSVLLFARDTSNDPEQLLRNHLNQVGHTGGLEQVEMFLLAYAVRHSIRVYRLSKYNTEEFITVYPTDPPKDWPMVTLIAEDDRHYNIPVRVCEETSV

SEQ ID NO: 2044 - DNA, 48680 bp, Homo sapiens
aaatataatgtgagctgcatcatacataacttaagattttctagtagccatattaaaaaagctaaaagcaacagttgaaattagtatcttatataatgcagtatttccaaaattttgccaacatataatcaatattttaaaattataggctgggtgtggtggttcatgcctgtaatcccagtactttgtgaggctgaggcaggaggatcgcttgagcccaggagtttgagaccatcctggacaacatagtgaaaccctctgtctacaaatataaaaaattagctgggcatggtgctgtgcatctgtagtcccagctacttgggaggctgagatgggaggatcacttaagtctgggaggtcgagactgcagtgagctatgatcattccattgcactccagcttgggcaacagagtgagaccctgtctcaaaaaaaattatgtgattattttacattctttttagggggtgtactaagtccttaaaatcctgtgtttttcacaaacagcaaatcttaattctgaccagctacatttcaagtgctcaggaggcactcttgcctactggctactgtattggacaatgtagctcttgaggcacacactgtagaaaggtttggcatggctgagaaccttttgttatttcgttaagcagggatatggtaaacatgaaggaagtggttagaaaggagcacaggcctatttacgccctcaggcacctgtaaagcgtatcttctactccagggcctttgctgcacagctgtataaaattggtgttgctgcacctcaggagatacaagtgcctcagtttgaagaccactattttaagatggattctggctgccaaggtctataggaatgatgcaatagtgatgaaattctatacattcttattcctaaattctggaccaagacaaaagaaaaatgtgtgagacaaaatattagcagaagatccagaaagcccttgtgactttgccagtaatatcctggtatgatttttaaagataaggttgacaacctaccttctcacaagtagagtttttggtaatagtaggtatattagttatggttctctaaagagacaaaactaataggattgatgtatatataaaggggagtttattaaggagtattgacccacatgatcacaaggtgacgtcccacaataggctgtctgcaagctgaggagcaaggaagccagtccgagtcccaaagctgaagaacttggagtccaatgtttgagggcaggaagcatccagcacaggagaaagatgtaggtcagaagactaaaccagtctagtcttttcacgttctgcctgcttttattttagctttttttcatgttcttctgcctgcttttattctagctttttttaattctagccacctagattgagggtggctctgcctttcccagtccactgactcaaatgttcatctcctttggcaacaaacaccctcacagacacacccaggaacaatactttgcatccttcaatccaatcaagttaacactaaatattaaccatcacagtagggtgatgcttttccttgtgactaccatggagacaaggtcaggctgtgagagaatcatcaacctaacatcagactacttgaggaggtgaaggtttcctgtaagtgacaaagggtctcttccttacctttattttcttaggaaacatctatgatttgtccctctagctctttttaagttccactatgtgacatcaatgatgggcttcctttccaaagaaacccatatgcttgtcctaaaaggtaagtgtagggaattactctgtagggaattacctggccctagcagaccaagataccaagactagatggcttaaataacagatattttctcacagtaccggaggccggaaagtaagattgaggtgccagctgattcagtttctggtaatggctttcttcctggttttcagatggctgtcttcttgctgtgtcctcacacagtgagctctggcatctcttcttcttataaggacaccagccccttcatattagggcccaacccttttgacctcatttaatctttattttgacctcatttaacctgtaatccttgtaggccctatctccaaatatagtcacattgggggttaggacttcaacatatgaattttggggagacacaattcagtaattcaatctatagcagaaactaagctaccaagagtatggaattccatttcagaagctctccaaaaaagttaagattatcatctgcctggatgattcttaagggtgaaattccgtttagctagaggcaaatgactgatttaatattttccagaactccaagtctgtgaattataatggcatcattctctctcctccttatatataaaatggtttcattttcatgataaaataaatttcattatgacccatacttctcccaataaaaactcctggggaaagttttgggggtttccaggtaaactaattttacagcaagatattttttctattgagcgatttcctctattttttctctataaagttatttcctttagcttcaaaactacaaaagcatagtaggttttttccccctctaattctgttttttaaaaatgggcattcaattaaaacctagatgatgggttgacaggtgcaggaaaccaccatggcacatgtatacctatgtaacaaacctgcatgctctgcacatgtatcccagaacttaaagtaaaatgaaaaaaataaaaaatacagaaatgggcattcaataatcaagaggcattttgaataagtctttaaaattaatacttgagtattcctagagtagttaatttctaagtgaaactgacaatagtttcttccaaagcttggttacagtccatgaacctataaaactagaataaactaaaaagtacctttcctgtgagtactttagagattgatgtacagaatacacttcaaatctaatttttattgctgtggcactgggaaattccagagagtataaaaatatagggtattttaacctgactgtaaattatgagtttatagtattgaaaagggggaatatgcatccaacttgtgttaagctccttaaagaaaatttttaaaaataagaacactgtaatggcttagcattgttctttgggaacagttattacaagtaaggactacagcattcagtgaaaaggaatgtggaatctttcacatattaaatattctaggcatggccactgaagcagatatataaattcaaggtgattgattgaaaatgtaagttaccaaatatttgcaaattacaataccgtatttatctaatgtttgattctaagaagaaactgaaaactgacgcattgtttgtaagtgattacatagacttttacttaagcttatgggtttttatgttatttatcttgacataagcataggctgttataattatatcacagttcatgggttttattctcatgactgtctctaagaaaccctagtgtttggccgggcgtggcggctcatgcttgtaatctcaacactttgggaggccatagcggacagatcacttgaggtcaggagttggagacaagcctggccaacatggtgaaaccctgtctctactaaaaatacaaaaaaaaaaaaaaaattagttgggcgtggtgtcaggcgtctgtagtcccagctacttgggaggctgaggcaggagaattgcttgaaccggggaggcagaggttgcagtgagctgagatcacgccaccgcactccggcctgggagacaaagcgagactctatttcaaaaaaaaaaaaaaaaagaaagaaaaaaggaaaaaaaaagaaaccctagtttttgacttatttatttaatacacatatacatccctctaatcattttgttctgtaatatcagtaaaaattagcatatcccaaatatgaatatattaaaaactcacgctgcatctctgtatttattatgtacaccagaaacatacacacaatagaaattttaaaagataaagacaaaatgatttaacatttaatttttaatttttttttttgagacggagtgtcactctgttgctcaggttggagtacagtggagcaatctcggctcactgcaacctccacctcccaggttcatgcgattcacctgcctcagcctctcgagtagctgggattacaggtgatcacgaccatgcccagctaatttttgtattttcagtagagacagggtttcaccatgttgcccaggctggtttcaaactcctgacctcaagtgatccacctgccttggcctcccaaagtgctgggattacaggcatgagccaccacgcatggacaacactgaattttttaaattaaagtacaaagttagaacaatgactggatattcttattttggaaggtcttggtttaacattttatgatatgatggtttgagtttatttatttatttggagacagggtgtcactctgtcactcaggatggagtacagtggcacgatctcagctcagtgaagcctctacctccgaggttcaagtgattctcctacctcagtctcctgagtagctgggactacaggtttatgccaccacaccgggctaatttattttttggtagagatgggtctttaccatgttggctagactggtctcgcactcctgatctcacgtgatccacccacctaggcctcccaaagtgctgggattataggtgtgagccaccgcaccccacctgggttttatttttgattaaaaaaaaatagagaccttattttttagaacagttttagatttacagaaaaattgagaagatagtgcagagttcctgtatactctgcatccaacttcctgtattactaacatcttacgttattatggtaagtttgttactttttttttttttttttgtgagacagggtctcattctgtcacccaggctggagtgcagtggtgcgatcatggctcactgttgcctcaacctcccaggctcaacaagtcttcccacctcagcctcctgagtagctgggaccacaggtgcacgccaccacacctggctaatttttgtctttgtagagatagggtttcaccatgttgcctaggctgatcttgaactcctgggctcaagcagtcctcctgcctcagccacccaaagtgctgggattacacccaaagtgaaccacttcatttgttacaattaatgaactagtactgatatattaactaaagtccatggtttattcagatttccttgtttaacctaatgtcttttttttgttgttgttacaggatcccacccaggacaccagaattacatttagttgccatctctcctcttcgctgtgagtttctcatacatttcttgtttttgatgaccttgacagttttaagagtactggtaaagtattttgtaggatgccccactaatggaattgtctaatttttttttttttctaattggactggggttgtgggtttgggggaggaaaaccacagaagtacaatgccattttcatctgatcatatgaaggttacatgccatcaacatgatttatcactgagctcaggtcacgtattaacttggtggcctgtttttaagttttcagtttctaagatccagtagcaaaccaaaagttgttccttaaaagtagagtagttacccacaatgacagagatttgcttcaaaatcctaagggtttgtactgtgattcacctatggttgcttgccaaaattctaaacagtgtttacttatcttttgggagaaagggccttgctctgttgcctaagctggcgtgcaggggcatgatcatagctcactctaacttgaattcctgggctcaagggatcctgcctcagccttgcaagcagttaggacagactacaactacaggtatgcactaccatacctggctaattacatttttttttttttttttttttttgtggaggtggagctggtctcaaactcctgggctaaagtgatcctccccccttggcctcctaaagtgctgggattacagatgtgagccacggtgcgtggcctctcaataacatttaagtcggccattgacactttaagtaccatcagatctgctggatcatatggcccaaatggcagagcaacttgcccaatagcctggacctgttgtagagccttctcttctcctactaggtattgtggtgtgtgtgtgtgtgtttttttttggttgtataaggggccaaatgcaacaacttattcttcagcttacaagtggtatcttgacatgtcctatactggtcccctaggaatttcatgaggtggagggccccagatgttttgtgacacttatttcctgtcttcagacatgtaaatattttaccaatatgtctagagtaattgctacttcctgctcaccatgagtaatcggcataatatcatcaatgtaatggaccagtacgaagttctttggaaggggaagactaaattatgacatagggctaaaaggttgatatagccctgtagtgggacaggaagttgtacagtggtcttgccagttgaaggtaaattccttctgatggtattttctaataggtatagagggaaaaagcatgtgcctgattaacagctgcataccaagtactaggagatgtgttgatttgctcaagtaatgaagcatctaaatggcagtgcaactggagtcaccatgtaattaggtttataagaatctattgtcattttccaagatctatttctgttttgcacatgccaaataggcgaggggaaaagaaatgtagtggttatcaccacctctgcaactttcaagtctttgacagtggcacttatctttacaatctctccaagaatgtggcattgcttttagtttgctattctcataggtataagcagttctagtggcttccacttggcccttcccgttacaagtctttacaggtcagggaaccaacatggggattcttccagctgttgagcctatctctgtttgtttgtttttgagacagagtcttgctctgtcgcccaggctggagtgcaatggtgcaatctcggctcactgcaacctccgcctcccaggttcaaacgattttcctgcctcagcctcccgagtagctgggattacaggtgtctgccaccacgcccagctatttttttttgttgttgttgttgtatttttagtagaaacggggtttcaccatgttggccaggctggtcttgaactactgactttgtgatctgccctcctcggcctcccaaagtgctggtaatacaggtatgagccaccgtgcccggccaagtatatctcttttaattatgcattctggaactggggaaatagcacaggatgggtccagggactcaacgggtctaatgagagatgaacctgagctgaaactccattgatcactcgacctccattaagcctctactctgactggtaggccgagtaaagcttttggtttccccagattagtatcaggtcagagccactgtgtagtaatccctgacaaatctgattatttctcttcccccaatgcacagttaccctggtagatggctattggtctcttcgggggaaataacaatatacatttttggcaatgtagcagactccttcctcaagaggatccagcctctccttcattcagagttctgagagtgtaaaccggcccaagtctgggaattgattgagaggttgtgactattttggtgatgcaagttaggatatctgtttcctagagacacaacgattaactagccaacagcacacgtctctgtaagtaagacaatattgttttagctctgctggtaattatagtaatcatgcccacctactttttggcaattaagtgccaccctggggggacacttaggaatcctagtttgatggtagcagtttccactgtaagatatatgtgactaaagagaagagcagccgcagatatcttcaaggatgctaggattctcctcacaaatttacttcttagtcatggtgaaaggtatgtcttctggaccctcctggggtgggtaagcaggtcttaaatgataaatccactctaatattccaatctccccaagcctgtggatacctttctctacagatacctaggcagttctgtcgcttcaacttcatttagcataggcccttctgggtggatggaggttaaactatcaatggagttttcactcagatccttctcacggtgggctcagtgggtccccaaacccatcctgtggttattttcctagtttgacatgcataattggaaaagacatactcagcgattaaacatagcattagagctttttctaagcctctgagataaaacattgaatccagaatctctggtgggtccatatcaataaatttggcctgacggaatttataacctttccaccttgatccctatatgagtttcctggggtggtcatgacaaaggaccacaaactgtgtgtcttgaaacaacaaaatttattctcttgcagttttgggggctagaagtctgaaatcaggtttttggcagggccaaccttcttcggaaggcactttggaataatccttctttgccttttcttagcttctgctggctcctggcattctgcggcgtttcttggcttccagttgcatcactccaatccctgcttctatctccaaatggccttcttccctctgtgcacatttatctatgtgtccccttctaagggcgccaaccattcgatttagggctcattctataccagtatgacctcatcttaaccaattacatctgcaaaaaccctatttccaagtaagttaatatcgtgagggtctaggtggacgtgaattttgggggatcctgttcaaccctcctcaatcccacaccttaatagtctttgtatattcttttgtacactctgaattttttagtatgtgcatttattactttttcaagtaaaattaaaggagaaaacaatacccccggagttctgtggcactaaatataaatattctttctgtccagtttctcccttggaggtcactactatttagtctccctaagctggtcttccaagtcctgcccttctccaaacttttaccaaactgaagacaaagtgatttttcaaaatgatctcaagatctgtcaatgaggattaagcataagcgccacagttagcctaatatggcttttcatgatctggtctccactacccctctttcagtttcatctttcaatacaatcccctgctccctacctgttccgccctggactcctcgcgggtttctgaactgcccaggccattccatcccgccctattccggggctgcactctgcttcagcgctgcttcttgcacccacgactgcaactcaaccgcagaggctactcctctactccatcccagagatgaagcatttcgcctttggatgcttgaaaacggttaatattttcccttttgtttctcttaaatcaaaatgtttacatgaaatactatgatccaagaacacacactgctgcgcttgcttaaccgggtcgagttgaactagttcgtcttctccgccccaaccccggtgccgtaactcccagccccggagcaactagcctggcccgacagcggaggcccaagcccgctgggctcgggcgttggaaccgtcccggcggggggaagcccgggcaggacgcagccgcgcttcacagctgaggaaaacccgctgcggcgtagggcaacgctcagaagccgagagtggcaccgcgacgcgccggaacgcgtcagcatccttcacacctaagaccagacttcctcctcctcacccaggacgctccccgccgctcgtccggtcgtttcccgctctcacaccctctgccagtccccacacagctgacaagggaagcaagccagcggcgtccggggacggagcaagcgcagcagccgcagcgcgcggttccccctccaggccccggcgcctcagcccgcacacgtgtatgcgcatgcgccgcgtccgggcccttcagcctccggccgcacctcctcgcgcagggtcagaggccgtggggcgggccacggtgacgcgcgcggaagcgctctgcggaccctcggaaaccgccccggcggctgagaggctgcggccactgcctggcaccccgacgggaggggctccggatcgttcggagccggctgaaccccttcggccgcgagcgaccgcatgagtcgggggactatgccccagcccgaagcgtggccaggcgcgagctgcgccgagacgccggcgcgggaggcggcggccacggcgcgggacggcgggaaggcggcggccagcgggcagccgcggcccgagatgcagtgcccggccgagcagtgagtccgcgggggcgcggggcgcgggccgtgggcggcgggctcggtcccctccggaagccgggctggggtggggagtcgtcagcggagggtccctgggcgtcttcaattctgagtgaggccgttggcgacaaggaggaattggcagacagttttcccagtgtccgagtgcagatttttaaccccagggcccctcacaattctggtcacacagtgactcccctctcgtctcatttttgatatctgcatgtctgaagttaaagaaagttccagaaacttgggaagcaaacccgagaagtgatgtattttattactggttcccgctagatctttccttcagcctggcacagggaggaagtgaggtcgaccctgctgcagccgccggagaacggcgctgcgcgacttgttcttggaggcgacgtcccacctgttggacagactttggacccaaagagaatctgacccattctctctgaccctttaacggcctgactagtatgccttcccgcttttccttttgaaaaggaaagtcagtgctggttagatcaatttcttactgtactgtgaagacgacgatttgggaagagttcctaatttctgcaagggtctgggggtacgcgtggaagcagaatagaaactcgagtgaaacttttctacactttcaagttttaggcacctataaatgcccttggaatttaagaaattatgaaagcacacagacagccagtttgacagatattttaactggctggaaagttaaatttaagatgtgtttaaatgcaaaaagcactgctagaacttttgaaaaaaaaattcctaaaaaggggtcctttggaggcctgttaggtagatattgtgttataataacatatttgcatagtacttagacattctcatttgttgagagcccccttgggatggtgttattcacacttaatgggttaatggccactggaaaataagattgaaagtcagcgggattaccttttagcatgagattggaggggagaaatatccaaatcatatcagagacttaacctcagactctgcagagggttaaatagagggtctcttgcccccaagccctgctccacggcccgtgctggttcctaatcgctgctttgcctgccttctaccctggtggtgagaacagtgcgcttaatttaatgccctgtctcacgtgctgcatgcacctcggccccagctgtgtcatgcctcctgagcaatgcagaaactttgaagccagaccatgttctcagaagtatatgtagttatttggcaagttttctggtggacatgattctcattcagaacacctgtgaaaacagacaatgataggaagagtgctctttcttgaagagtttttgtggcacaggtgcctcttctgtctgctgctagtagaactatatagacttagagctgaaaggaatgtaaaaaaaaaactagcctaggtttgtcattttacacattcacagatttttaaagtgtagcttggctggagagaccctgatgcatcaatgggaacctccccctacctcttctgggcttcctcagcaaaaccaggcagagagacatgatttatagtgacagccaacttcactttttttccccccttggtttgcttcccaagtttgcttcccagtagatgtcccggtttgtgtgtgtggtttttagcagcttaattttgctttttccttatttttgttgcgtttgattatctcattctctttcacctctcataagatggggcagaacaagagaggtgagtttaagatgtcaccttttaaacatcatgtctcaagttttggactttctagcctttttccatctttctgactcggcagtatctgggtagtgggctgtttctctatggtattttcctcacggcctagagaaactagtacagttgtcatataaacaaagtttccaatataaggtattcatgtcaattcctgcatgatgatatatacagcttaatagttgagtatcaatttaaatagtgtaatgtgcatttttagtctgtgtttttttgtcattggagccaaggcctttctttccgcccagatagttgggtttgctatgcagaggaattatttaaaatgtttacacttagaagtgtgaacactgtaagactgtagaagttttgagatatcctatagagtcatttttaatacattcagtggacagtaattacaaatacaaatcatagcccaacttctgcagctgaattagacattcgggatgtgactctgaaggctgtggtgacgagtagagaaagagatggcttatttcctaggtagcacactaggttactcttgattcctttccactaagctcatcgcatttcacacgtgagagaagtgggggaaaagaaacattaaccacatggataagctactttgttttcttgttttgtgagacagggtcgctctctgttgcccagtttggagtgcagtgacaatcatggctcactgtagcctcaaccttctgggctcaagcgatcctcccacctcagcctcctaagtagctggggcaacaggtgcacgccaccatacccagctaatttttttttactttttgtagagacagagtctcactatgtggcccaggccggtctctacctcttgggctcaagcaatcctcttgccgcagcttcctgaagtcctgggattacaggcgtgagccacagtgcccagtgatgaactactttgtatatctcattgcagtttttctttccctccctcccttccttccttttttccatacacccagcagctcatttgagagctgtggttggctcacatctcctggacaagtcctaaggatggcttgaaacataacttagggtcatatttgaagaactcttttgtcagaccagattagtttaccttcaagctccctctgctgctctcctatgctctatcccctgctcactccacccccaatatctgactcctgctgatctggtcctgggacatggttgctggctaggccagaaatgcttagggaattgagaagagactactccatggcccttctctgcctgtctgagggtgagacagggtttgaatctgtggaggcatactgtcggtgaacccctctgaaattgaaagcaattttatgtatgtttctgggcttaggttctgatgaaatctgaattctcagaggggctgtgaacaaaaaaagtggcacactgttgttcttgtggatgtattttctgccccaccccacccccagatgctgctacagttcggagtagggataaagtccactttctcccaacctcatgaagagcctgctttgaggcccagagctgggatgtctctaagaatcaaaccttattgagagtggctgcattgaccccggatacctctggaagtcacatggagtagcatgagccagtcgtggaaagtccacttgcagaagaggggtggaattttggcctgggtgccggtactttcctgtatttgatgtgttgttcacccatctctgaaccgcaaagtggtgaagaaaggctgggttgagtggtctttgcttttcctgtgcctgtgtgggaaggtgtgttagtgtaatattggttgacactgtctcaccaacattgccttagtgttgacattagtctcataggagaggctaagttaagtatgaactgcagggttcaagtccagagagttgaattaaaaaaagccatacttagttcttatagacgactaaggggaacaacttttaaaaagttcataatggtgagtgattaaaattctgtcttgttagctttgcatatacattagaattgattttttttctgtacgtatttacttgaatcaaaaatggaaaaactggcttcacagaaatgccttcggcttcactaagttctgcttttaactcacagcttttgctcttgggaatagtataattttgtgtctgtacagtaagcatgtttaaaataagttttcaaaaattggttggtatgcaggtctttgaacagaacaagtggtaccagttataatttagtatgcaacgttatatagcttactcagttggatatgttgccttaatatcaaaaataaaatattttatctccaggttaagagaaaataggtaaataggccgggcgcggtggctcacacctgtaatcccagcacttttggaggctgaggcaggcagatcacctcagagtcaggagttcacgaccagcctggccaatgtggtgaaaccctgtctccactaaaaatacaaaaattagccgggtgtggtggcagacgcctgtaatcccagttactcaggcgtctgaggcaggagaattgcttgaacctgggaggcagaggttgcagtgagccgagactgcgccgttgcactccagcctatgcaataagagcgaaactccgtctcaaaaaaagaaaataggtaaatattgtttaataggaacttgaaaatatacactttaaaataatgccatagtgcaaaactaagtattttctaactaggaattgttagcatttggttttaaaatttaggctgagcacggtggctcacacctgtaatcccagctctttgggagatcaaggtgggaggatctcttgagcccaggactttgagaccatcctggacaacatagtgagaccctgactctataacaaattttaaaaattagccagatgtggtggtgcatgcctgtggtctcagctacttgagcctgagatgggaagactgcttgagcccaggaggtcgaagctgcagtgagctgtggttgcacggctgtagtctagtctgggcaacagagtgagaccctttctcaaaaaacgtatatataattttttaaatcggcttaattatttttaagttgtacatatttatggggcacatagtgatgttttggtacacataactatagtgatcagggtaattagcatgtccatcatctcaaacatttatcatttctttgttttgggaacacctaatatccttctagctgtttgaatctatatagtagattattaactgtagttatcctacaatggtatagaacactagaacttactccttctatccagctgtagttttatcctttatttgtatcctttaacaaattttaactgtggaattgaggttgactgccagaaaatcaagtcatttagactttggcttaacttttctttaccacacaaagaatgtgtgatctggtgatcacctgagtcactgagcttcagtggtttcttttgtgtcagagtggatacctctccaccaccaccccaacttgacacacaaaaggttgccaaatcccttttcctcattgttttattatcttcccatcccataacaaaaacgtaaacttaacctctacctgttccagattcctggcctttagtatcatttcattgtgtcattgttttcagctttattattttaatacttaaaaaattaaaccaaaagtttattgagtgaagtatttttaaaataaaattattattttttggctctgtttcttcctctctttctgtttgcttatctttctattagacgggtaactatttcattctgcctgcgaaatgtcctccttcctgaatatattgattgcgcttcattgctcaaacctaaaacttattcttcgggattattttttaaaaattaattaactaattttttttagtgacagggtctcactctattgcctgggcaggagtgcagtggtgtgatcatagctcactgcagcctccaactcctaggcttaagtgatcctctctcctcagcctcctttctaggggggattacaggtgagtgccagcatgtccaattaatttttttttttttttgtagaggcggggtcttgctttatgcccaggctggtattgaactcctggctttaagcaggattatttttattttaatggtggcctttagtaaaggctgtgttacattttctgtatgtccttggtggccatgaagttagcagatgtttgtgcacaggatctgagtgaaattcagttgtggttaaagcaatttgattatactctggttctcttattcttccatttctgctttgcttttttcatatatcctgaatctgtgctctttatttccagtaatttcccgttcagcttccctttgcatttagttctcctgtttgttctgctgtttgtttcctttcctttcctgttggcctttgtaggaatttgtacttgtgggatggagagttgcttgtttagagaacctcctctgggcattgatgttggattttggttattttgtagattaaaaagaaagagaacaaaagtggagccaaatgtgcatgtagtatagccacagattttgctcgaagtacagttttcgtagacttagactaaagaactggaagaggaaccatgtagcttacacggcctcttccagtcttctcattttgaagatgagaaaactgaggccgtggggaagtggcttgcccaaagatatatgcctctgataatgatactatgaaagtgctttgcttaaatgtctgttttacaggattggaatttgtcccttattttataaagccaggaaaggggctgaaagatgttaaattattgagagaagaacgaacacatttggtcacttttgattttaggcctttgatgtatggtccccatgaatcaggtttctgtttgtttttacctctggcatgggctctaaggatgacatcacactttttacttgaaatctcactggaagcaaaagcacatggaaagtacctttttctgatacttgttcccttaccctcacaacgttaaaatacacacagttacacatttagagagaaaaaaagaaataaaaattgataattggtcagattgttcattaatactttgcaacagtggatataaaatgagaataagaatagcttacttaattttgagtgctaattattttccatgtatctgtttcttaaaaaagccctttaaggtgaatactcttactgcccttttgacaggtggttaaatctagatgccgagaggtgtagttactctagtcatagttatacatacagctaataaggaccagaatgaggactagttaaataaaccctggcagtctaattcctgggtccccactccaatcattgcactctgcatgcagagggcttacccacatggcgtgtatcgtgatgtgtttggcagggggcaggtcaggagttgtgggccgttcaggaagagggaacatctgagcaaatcacagatgtatgggcacatgataatgttggtcaggcgtttggactgaagtgtgagtaatgcatagggaaataatgggatgcaggctggagtggtgggtgaggtcctaattttgacattggttccctgagtgggaaccattgaaaggttttagtggggacatgtgagacttccttcctcagtctggccctcccagtaccccttcttcatctgtctcttgctgtctgacttcttcctctttcccccagctgtactaggccatataccaggagctggggtgatgagggaattgggggtaggggtatctcagtcattcactgaatattttttttttagcctggcacctcctccttcctgtgttccactgggtctgcagccttgtgtgaggatggggtatgcgctcatgaggcaggagtatggggaatcgggggtctgatcattgcttatgtgaaggtcagctagtctccttgttttctgctcagtgtgttactcatgcctcctgaaggacttgatgcctccagttcctgagcctttctggggttctgccaggttttctgacttgcctgccacggatgcccatctcccagccttggcttccctgtcctgtgtcatttaccactccatctgctttccagctctttggactttcacctgtcttctggtttcatgaaagatagaatttgggtttctgtttccctttattgtcattttggggtgaatcttgggggaaaaggggtgcatcttcaaaccagaagtcccattcttcatctttgtctagcatctagtggattttttccctttgtagtacttagtgggctcttgctagttaactaaagtactagagactaggaagctctgagtaagaagtcggtagtagcggacagtgggaatctatgtaacagctgcatgggtggctggttgattgtggggtcaggaagcaggaggatttcgaggaggttttttagctttggcgatttgtaataactgatggtctcttcttgtttttaaggtagctattgtcaggtttgcttgtgacacgttacaaaggtcggcaatggggcctgcattcctatataaatatttttatcagcactatctccattcttggaacttgacagaatcagttcaggagcttcactaataagatgcatgctatgatgtctagatatatagttgaggcactaataggcattacaattaaaatgccttcagagctacctagcaaatgaagtgatgtaacttgtcttatttaagtaagaaattctgaagtagaagaaagtggtgagatagaaacataagcatctttattcttaagatagaagactcatattttattagattatcatcatgtaaagtgaaaaaagttaaacccttagtatattatgcatttgtaagcagctgtataataggacggaaaatgtcagtgcaacaagtgtttgaaaatgtctgctttggtgtaatttcagtgaggaggacatgtaccgtgctgcagatgaaatagaaaaggagaaagaattgcttatacatgaaagaggggcatcaggtatgtttggaattgttttatttatagagttcttattgtttatagcagaaaatgcagttaaatccgtataaccattttcataaaatatcaataaaatattcttatgtatatggtcttatctacattgattgttttgctgaagtatgttagagactgtttcctgaggcttttaaattttaatgcaaacattctctctgcattctttacattcatatcgtttttcacacctatgaggattgttttgtttaatctcttgacaccgtcctctctcagttcttgatttccttatattcttagagggagagttcagatttgaagtgcatttttcatttcaaatggaaagacttaactgagaaactggctgtgcacatctttgcatgcagatggccatatgaatgtgattaagtaataagaaagacagtgatgggatcagtagcacagagtctcatcgttttgtgatttcatgtctgtgtttttcttgtcttgcctgatcttaccccaaccaggacccattgctgccggagtgaggtgttactcctggacccctccgctggtccgtggagacttggctggcaaagttgcatgtgacgtacatccttagttccctgagtggcctcatgcaggagctgcatagggttactctgattttgggatatcccgtgaataatcacaagtggcattttctctttcattacctgtgtaatgtataaggagacttcaaaacggttgtggaaaaatggaattgaaagatagaaggctgggtgtggtggatcatgcccgtaatcccagcacttggggaggccgaggcgggcggattgcttgagtccaggagttcgagaccggcctgggcaaacaaggagaccttgtgtctacaaaaaatacaaaaattaatcgggcgtggtggtgtacgtttgtggtgccagctactcaggaggcggaggtgggaggatcgcttgagcctgggagtttgaggatgtagtgagccgtgattgcattactgcactccaacctgggtaacagtgagaccttgtctcaaaaaaaaaataaaaaataaaaatataaaccttatttctcaacataagctccatcagtttcaagccacttttaaatgatgataccagccatttgttggactcatccctaaagaactgacaggcctgggaatttaacagtgtgaatgcagcagtcttttttgcattattagctgaagaaaaatgtgtgtcctttaaagcttcttaagattaggaaacaaaaggaagtcagaaggagccagatcaggactgtaaggtggatgcctaatgatttctcattgaaattcttgccgttgtttgatgttttttcttgctttaattttagcagaactcatgttgctctaataggggctcttttcaagctgatgtcttatccttcttagtgccttagactagatcctgttcatacatgttataacaagttagtatgagtttattatggtgccaaaaaaaattgaaatccgtccatagctttttcataaaactcattttccatgaaccttagaagacccttgtctgtgctcttctgttttgagaactggcttctgtttttggtgaacaaaagcattgtcatgtgtgattaggaacaaatgatacacagtgtggtttttataatacttcttgagcccccctcaagcaattggtgaactcttcactgtggtagccacaggaagatattctttgtagtgatgtgtggcggggccgcaccgttccagtcttccatgaaacttgaagaatgctcagtctctactctgtggttgttcaaaatttcatgtagggtgcagtgtcctcattagtcagattcctaagaagaaagtgtgtattcagctggtgtttgttaccgctgacagtatttcaccctgtaggctctcggttgtgattctcttctgtctggcattgtaccccacacgggcaatcaagctttatggtgggtcttgtaactcctagctttagtctgagagtgaaatggatccctttacacttctcacatcatctcagaccttctgggttcattgtctttcttgaaataacatttgttaccctctcagagcccaggctgaggcaaaaagttttcttatcctctctgttagtgaaaatatttttttccaccttgcctgagagtcagcaaacaatggtttccaggccaaatctgacttgccacctggttttgtcgataaagattttttgaaacatattaatttacatattgtctgtggtggctttcgtgcatagtaaagttgagtagctgtgacagaaaccttatggctctccaagccttaacttatttcctgtctggcccgttacagacaaagattgagattcctatcctattccaccctgtttgagagtccctgctttccggaggggtttcagttttaacttcccgccttctgagggtctgattcttgtctttgtcacccatgtggtggttaaagatgaagcctcttggttatttcaacttgtggcttaccactctggttttcaacttccctatttttctattttttatttttttgccattagaaatgtccttttttgaaaacagcagcgtctgtgtagtttgcaactaaagaaagttgcttttgaactccataagctgctcgaggtcaggtactgccttgtcctgcatctccagctcctagcctggtacctggcatgtagtagccattggagtcctcctcagaggaccacagcagaatgggaattcaggtatttgatgctgccagctgtgccagtacccattttcccaaccctcactacgctacgtaggcctctgattcagcacttggctgtggcctgtggcttgatctcttggcctgtgtgaggcttgtgcctcctcccctcagtcatggggtgctgggcttgccccaccctgtccaggtcttgtcttggtgtgcacaggaatgaggactgcagggaggagagcaggaaggtagatttccttcccaggagtccctttctgagctggacatgtgctttctgttcaggctcataaccctacctggaggaaaaatgtggaccaataagtgtcctgactctggacattcgcatttcttcccttttgggcaggggaatggaaagacagctacatgagaatgcttccatccactaagtagacatgcaaaaaaatatttctcgaattaaaaaaaatgaagattctttaaggattggctgtgcagcattggtctttgtggtccctgtatattatacctcaggagtctgcttcacttttaagtgaatcctgatgtgtgccacagataaatatgtctatgttatctgtatatgtattattttctcttgtatgtaaaaagttacttttctttgtaaaagaattcacagtgagattattaaaaatcagcagttcttaagagtttacttaaaaaattttttttttaaatttacctaaactgcaaggaggatttagggcctcttttgtgctcctaatcatcctggcacccatcacaccctggtttataagtgcttgttgtcttttctcctccagcagtccataagccccttgaggatagaatcctgtcttcatcaccttttatccccagttcctagctcaatatttggtacattttagacactcagtaaatatttgttgaatttagttgaataaaacatttttattttatgtacaacttgctcaggagtaaatatgttgtaaggtacttctgcattctaaaatcattgctagcatctacgtcttcagtaatttaaaaaggaagtcaagatgtgcctgaaaatttacctccttttcttcctaaaacacacacgctaatatgtgcatgtgcgtgtatatgcacataccacaaaatcaaaccccaaaccatatatattaaactagggaaaatataaaggctatttttttttcactataacatttgtctgatggtgagttgtatttttaattttgggggatgtgttgttagagtcaggtgaggtctgtggattaacaaacatggagagttctgttagtttctggtttattatcgaccacttttagctttttgggatcagggtaggacataaatacattaagataattaaatgtaatttttgttatagtaggtgttatttctttgtataatggttataaaaaactgattactcattgttagaagtgttttctcatagttcagactgtcgcgtctgtaatttgattagaaaagtattcatgagcacctgtgtgtcagtgcagctccagatgctgaggacacaacacaactgagaaacaaaacaaagtccctgccctcaaggagcttgtgttttactgtatttttgtatgggtgtgtgtggggggtggtgggtgagtggtacagaaaaatatttcaggtgttgatgagtgctaagaagaaaaaccaaatggtataagaggaatagagagcaaaagtgtacgtgatactatgatacaaggtgccagctgactctggagcagaggcctgcatggagggagggagcagctctgcaggtgcggggaagagcaagccaggtgttttggagagtactgggaggctgtagctggggctggagcccactcagtggggaatggtaggagcagagaccagagaggcagagagggggactatatgaggaataaggccatgaggcaggagcccctggagctctctgagcgcaggagtaattgataccatctgattcacgtttagatggatcatcctggctagctatcatgtggataatggtctggagagtgtggtgacaagggacacccattgggagacccccatggttatctaggggtgaggtgatggtggtctggaccagcggttaggcagtggttgaattctggattttttgacgtgaagaaagaaaatgaagagtgaagggtaacccccaactgaagcagtattctgattatgctttgatttattatttgctttttttttttttaaattctttaacagaaccgagattaagcgtagctcctgaaatggatatcatggactactgcaaaaaagaatggagaggaaatacacagaaagcaacgtgtatgaaaatggtatgacacagaggtgcacatatttcaggtctttcaaatagtctatcataagttgtttaatatgtcatttgatatttttagacattagttaaaatgactgctatagacgttattattggtgttctaattttagagttaaggaaatagactccaaagataagggttttgttttaagtcacagtattaatatagaatcagcatcagttattcagtgacgcaatttctttgaaaaacacgtaaatgactgctgttcagagttgggccagctcttggttgtcctcttggggccatttgggaatgtcctttttggtctggtgttataaaataaaagcctcagggatgcctcaggccgattccacacttctgctttccacagcacattgagtttgcttacacaccctctggtcctggggcctagaaccttcttggactccctacacaggggaatcaggaactgctcccttcaagatagtctccaaggctgtgggatgacattggagattcatatgatgtggtcctgctgtgactgtttggtccggttcattactcagctcagacaccatggcctacatacaccacacagctgatcaagcagcagaccctgtgggctctaccctcagatgtataccaaatccagtattatcagtagggtgaaccatgtgaattgctcaaaaacagtcaaatagcagatttaacctaagacttccatgacctcttgaaacctctgggtttatcttttgctcatttttctcttgggattatttacattatgaatttgaatgcacttcttatatattagagatactgactgtcatatttaatagaaatatctttaactttttttggttaggattttaaatttttaaatatttgaatatttagttttttcctcagagctcatttttatagaaaatgattgctcatctttcagcatgtacctcagctgcccatgggctgaccttagaaaaatctagctgccacttgtaaagctctgagagcagatgatagttctctgcaagtctgatatgtagatgctttgtgttttaggcgttggttagagaactcaattatgaaaaacctggaattcttagttcctgccagaggttaagaacatttatatttttgctaaatatgctgttggtcacttgcagattttccaacctctagcccatcaggacccatggcagtaattagagcatctcagatgcctgaaaacagctttcacctccattctattttagtccttattggcgtaattgtctgtttttgtttcgaatattcttttggaagtaagtttctacaaattcagatttaattttattctgaaatagcctgagtaatttatgcatttggaaaggtacaactgcagttggatttgcataagtattctggggtaattgaggtttaccataggcaagaagtacataattattagtaggtgtgattctgcctgatggaaccttatgtgttacagtggttggaccactaaataaaaatgcaaccctcaaaatgttgttattgggggaaaaaagtacttttatattcacttaaaacatcatcctatgacttgaaccttgaaaacagctagtaatgaggttctagtacctggacacacaggacagaggtggtctgcattgcgtccaccccacgatgagggtaacacttctttctttctgtgagtgcagggtaggaagtgggtcttgagtgactgtcaatgaaaagttggatgagttaaggggctgactcgacccagggtcagggagatggtgggcagttcagtcagtctcaaggactgtgcatgtgtctagctggagaagccaggcatcatcatgcctgctgggggaccagactcactaggattttttggtgtcttttcagggtacgtttcagaatggtccattggatggctgtttttgagtgcccaagcatgtcactgaatattttcatttgcttgtttcacttccagactgagcaagagtgacacttcacttaagaaaagaaggcggggcacggtggctcacgcctgtaatccctgcactttgggaggcagaagcaggtggatcatctgaggtcaggagttcaagaccagcctggccaacatgatgaaatcctgtcactactaaaaatacaaaaaattagctgggcttggtggcacatacctgtaatcccagttactcaggaggctgaggcaggagaattgcttgaacccgggaggccgaggttgcagtgagccgagattgcgccactgcactccagcctgggcaacgagagcgaaactgcatctcaaaaaaagaagcctaacagaattattcagccatctcctggcatatagacttttatgtatacatgcacatacacaaagcacccccgcccccctttgtgttttggaaacttggggtttttctatatttttttagtaggaaaatataaacttagtttagctctcttttttcttgccttttttttttttaaaagagtttagggtcatttgaaacacagagtaaacccttcaaaatgttgtttgccagtgagtaagtgttaaaacaattgcttagaaagggacataaaactccaactttgggcatcctcccagtgatcccaggccaagctttttccacaggaatgaaactttctctgctatctcaagtcagtaacgaccattttgaattctttcataccttttcccagggctatgaagaggtttctcagaagttcacctccatacggcgagtccgtggtgataattactgtgcactgagggccacgctgttccaggccatgagccaggctgtggggctgccgccctggctgcaggacccggagctcatgctggtacgctgctgctgcaggtttgagtccaaaatgtttcaaacaatttttgtgagaaaactttccctttctgtccatgctaccttctagtatcgtctgcagtatgatgtcagcatgtgcgtttattcagttttgtgtggctggggtgatttcacatagttaaatgaccaaaaataattggtgtttcctagaagagaaaaatgataaaatttatatgaacaatttagttgaattagagagcagatgtttgtataaagcacttaggaacagttcgatttcaattttggtgtttattttaagtaggctgtatatgttactatttgagaacctgctagggttttagaatacacatttctttagtttttagctataattcaataaattagtacttttggctaagtgtgaggattggcttagtaggtggcagaacaggaacactagaagagacatgattactgtcacatggagaggggcttcctgaggagctgagactcagcctgtcccaggcctggccctctttagcgttttaaatgtaccacatggcagacatgcactggaaagtcatgtgtctgcatgtcctgacacggataaaggcatatagtcaggtgggtgatagactatcctgaaagattttttggtcaggaatgattggtcagagacagcaatatacccatataacaaatctgcacatgtaccttctgtatctaaaataaaagttgaattgcaaaaaaagaaatggccacagccacccaatcttcaacagccaccaccctgttcagttagcagccatcaacatcaaagcaagaccctccaccagcaaaaagattacaacttgctgaaggcccagatgatcattagcatttttttaccaacaaaatatttttaaattaaaaaaaaaatgacaatatgacattaactggaagaaaattgaaagtcttgtgcttaaatttaaaaaatccaaaacccagaaatgctagccgtgggagattggccttatagcaatttatgaaaagaaagaaaaagatgttaggattttaattatgcaagcccactgtgagcctgcatgaaatgcgatggctagcaatgatcacaaagccctagctgcattttatttttattatttttatttttattttttttgatattaagcaaaaagaccaacctggctgcgttttaaaaggaatgattctaagaattaggcagtgacagccccaccttgaactgggctggtcagaggccatctcaagctcggtgcctgataaagtatcctcagcagatggaaatgtggccaggatgcttcttcacattctgggagccattgaaggaactggggtgttttcctagaataaagaagacttttagaggaacttgttgactaagctagaggtcttttaggtggatgagagatcacacgctcagaagggcaaaaccaggattgatgggtgaaggatactccccatctgttccatgattgtttaatacaccagcataaaatcagcacacctatatcaactgtcaaaatgacatctggagccaagtgtggtggcgcctgtagtgttagctactcaggaggctggggtgggaggatcacttgagccaggagttcaagtccagcctgggcaacataaggagaccccttgtattggggagtctattaaaaaaaaaccaaaaccaacatctgggaaagatattttcttctaagcaaagatgcatgccatcttaagccgatttttcagtattagcttatttctttcatatagaggcaagagaaatggatatactaagctgttttttcttttgtaaatgatgccatttattagtaaagtatttcagaattgccagttggcgaaagcattcctatggttggatataagacccaactagagaagcaaacaatgatttcactgtttttgctttgccttattttaacttctgtgcttgacaactgtagatatatatgacacaatttctagattttggtggtgtatacctatgttcttagctactcaggaggctgcgctggcaactgtggctatattatattaatctacaaatctgtatttctggatagtgacataatatcttcctcaattttaggcaaaattttccttttgaggctttacctttaaggagctatttggatttatggacttacttgacactaaatttgtatttttatactttctgagaatctggggtaaatagtgtcctaattaattaaataaagtataaaattgcttttaaaaaagttaagtacaatgtctccccccctttttttttgctagcaggatatattgggtaagattatctgccatattaaaaatagtctgggtagattacattcaaactctaatcactgttacaatatgttgcatgtgtgagtgatggggttttaaggtggtttttctgacttaatttgagtaatgtgaaaatagttttaaaattcttaagtgttctttccagtttctttccttttctatgtgtatcagctattatatttttctgggagcataatttaattagttggtcacttggtttggtttttgtcatctaattgaatgccaagaggcctctgtcagagagggaaaacacagtgtacctgcctgtgggtttgatatttatgtttattaaacgttggatctgaatgttagctgaagaacgtctttgttctttccttgctgtcatccagccagaggacttgtccttgtgttgctgttccagccctcagcaatttaacatagtttgaaaacttgctttacccagttcgttttgtggtatcacgtctgagacatgattggatgacaaattcaaattcagcacatgctttgtgtttgaggggccagtgaaggaaggaagggacccataagcttactctggttgtgcaaatctaccaggtggcccgcagaccctcctgtggatgcctttccattcctgttctcactctggcccccctggccccacagcccttcccttggaaggtccactctgacaagggctttgttgagtgagcgtttcttgcagtgtgactgaaataaatcaggggtggaacctttagctagctttatctgcttctgtttgcagattgagagatgttctctgtggcatgttgctgtcttctctgtcttttagaacatcatttggttttagggtattaaagggagctgggaaagctagactgagtgaccctccccttaatctatgctcggtgaagaagacccgggcttcctttctgctgctgctcagctttgctggccttgctctgttccctgcctgtgaggcagagctttgtccttatttgcccctctgacagttcggctgtccctcacctcctgtcatcctgcccaggtgtcctgtttgttgttcccatttctgcccagatcccagtctccgtgtttggctgcagccagatcatctgaccctcaccccagctatggagatggcctagcctggctctcaaatgtgggacaacactttggttcctgaggagggtaccctttagagtttggtttccaagttcgttacattttataatgtctctgaactggttagactgtgacagtgtttgcttagagtgagatagactgtgtatcaaaatttttttgtaagttttggggatgacacatttttattatttgctttctgttgtggtatcaagaattaccggcatatgctagagaaaacaggctgttttatagtttagtcacaaacaaaatgacacctaagctaattacctactttattcttgaatatttccaatcactgtttcttgtttaaatctggtttcttgcttaaattttctttattctaatagaagtccagtttgtgcttagtggaaaacaaaggttatttacgtgtgttccatgtgctgtgacctctgaaagcgtttgaagttgtattcacttttttcttctgaataaatttgacttcattcttttctgatggcttttttcatgcttcattttttaaaattgtcttaaggatttctgcatttcctggaagtctacaaccctgaactgtttgaccagtgtgtgaagggaatcagaaacaattgtttctctctgtgtagttaggtcttcagggtctcctgagtaattcagttgagtactgtacctactttttagataactgtatcatgtccccagatgctcagccggtcttctgggcttcccttcacctcatttcccagctcacatctgtgtagccagtattttctgcacatttgtagttcttttttttttttttttttgagacggagtctcgctctgtcgcccaggctggagtgcagtggcgggatctcggctcactgcaagctccgcctcccgggttcacgccattctcctgcctcagcctcccgagtagctgggactacaggcgcccgccactacgcccggctaattttttgtatttttagtagagacggggtttcaccgttttagcacatttgtagttctttgtgcccaattgtaattttagcttgttgccacttgagggcatgtgaggttcttgtgataaatctgagagactgaattgaaggttttgctgcagaactgccacatgttgccgaaacgcagggcagtgtgggcacggagtgggctggtgcagcctttaggtgggtggtcatttgttattctaataagatgaggaggagaagtccctctccacccttagtgagtgatgtagttcgccatcactgtggtcacagtgaaaagtaatttacatcccaatcgtggttctgtgttttgtagaaaccaccttagttcacacgattgctctaggttgagaaggtaccaccagaattactatttatgaaagggtcttttagtcttacattccagttgaatggaagatttggcctcatttaaaactgtatttattttattttatgtatttatttttattcatttctttcttactatataaagtttttaattttttggggatgaggtcttgctctgttgctcaggctgaagtgcagtggtgcagttatagctaactgtaacctcaaactcccgggctcaagtgatcctcctgcctcagcctcctgagtagctgggaatacaggtacatgccactgtgcccagtgaatttttaaactttttttttttatagaaatggggtcttgctatgttgcctgtactggcagaactgtattaataactgctaaacaaggtcaggttcctcataggatattgtaggatttaattattctttaatgatctgttgacttggaggtgaactttttttcctttctaaattttatagcagtgaagtgacacacctgtgcccagcctaattctaggatttttctcctgacacacccaagactgttggaagagtcttacttcccatgctgtcatcagtcaggctgtgcctcagcttgcctttcaaactgcagattgtgttgataactagagggaaacaaagtaacaaatactccaggaataaaaaaaatggaaactagcaatgtagttcagctgtcacttctttcatgaactaagtgagcacagctcacttaaccctgcctctgattttcaattgtatgttttatcttaatagatcgattagatagttaaactagacatagtatcatttctctgaatgttaaaacttgagtatatgtgttaacattatttaaccaaactttttctacctttttttggtggattttttaaatgccagaaactaggttttatttttcttattgggaaaggagaaggtttggcttcaccctggaccttctcacatgctcagaagcactgtcccgagccatgtgttaggtggtggttgagaggctgcagtgagtcccatagcctgaaggtggttggtgtgaggacgtgctgtgggcatggcctgctgtggaatgtcctggcggtggttggagtcctgcaaggcagattgtgctttggctcaaccaaaagcaccatttcactccagcagccctcctcagggtggtactttctaagttcctgacttctagatttaggtcctccatcctaagcccacatcacagatttgcagaattaattctggaaacaaagttaggttttatagactttgtggtttcttacagcttggattgtgtggtggatttcttggaatgttaacacttctttatctctttgtttctcgatgttgtagttaccagaaaaactcataagcaaatacaactggatcaagcaatggaaacttggactgaaatttgatgggaagaatgaggacctggttgataaaattaaagagtcccttactctgctgaggaagaaggtttggaacctgtagtgtcctgtctgataagggtgaagctctcgttcttgcttgccccagaagaccagtttttagtcttcactcagtggattttcaaatgctcttggctgatttttaggcaaaatggttttaaatgaattcaaactcttcccacgagggctttagtaaaatgggaagtaccaacaattcccaaattcccccgggaatgggggggggggccccgtttttcaagggttaaaaaattgggggaaatgtgagccgaagcaatttatattattcttagagcagatgccatgtactagggtatcaaataatgaagtgtttgactttcttaaaaggaaaccttaacaaatatagtctttgttccaagtcatatttatgtttcaagaatataatttggttcctatttcttatatcattagtaatttattaaattctttccaattatgctcatgttttaagattctgcccatatttatcagacttattttctttctccgtgattttccagttagtagatttagtaacttgtctttagaaaactgtcctgagagtttttctgaaacagaattgtagggagaacttggtcttctgattcctattgatttggtctttgaaattctacctttctgtggctttccactgtctcctctgggttggatgtcctgcctgcacactggcttacatgacccctagcttgctttcattgagcagcttggagcccttctcaccaagaaccctgattgagggcctgtcacttgcgccagggtgtcggtggagggtggtcaagtagagaggggtcaaacatggacttttcaaggtccttcctagcacgtacttcaaacagtgatttctgtactcacacatggtctgctgctcccattagactttcagctccacgagagactgtcctgtgcattccttgacaccctgtgtctagcagcaggtctggcacataataggtgttcatttagtgctttattgaattagtgaactgagggccctgacttcttggaacctagtttttgcttagaaagataagaaatgtttactggaaaatatactgtcaaaggaagtccagtagttttatctttcttttactataaagaaatgggagcaaaagaagggaagagggaaattccattcttgttacctgttggactagaatgcaggatttttgtgttccccagtccttgggttagtggaaggctgacggcagggctgtagccctgtgggagtgaacgagagggcccttcagcgcaaccacaggtcacaatttcgttttcatttttttaaggtcttgtgaaattgctatttctgctttattaggtttttctactataattagaccctcatttttgggaatgcttgagtggtgccaatttgcaataaggttaaaattactaataatctgagccagcattactaacacttctatgccaggctccacactaaaatttcatgtgttatttaattctcacaactatgaaggtggtgtcgctgtggtcatcactgttttttaggtgaggaaactaaggccaggagctcagttaaatgccctgcaaaaaccaccacagctgctctgtggtgaagccttgattccatcccgactgactttagagccatgtccatgattggcaacttggtctagtttggaaaatatgagatacagacaagcaagtaccagccttcagcccaaatattagagggaattgtatgcagtcattaccattgaattcactcttgtatttaaaatccataatggtgtttgagaggggcactagttattgttgattcataaggaatggtatttatgttggcgtctcttattctcattcactgtaacttaaaagcacatatatttataggttttcttttttaaagagtttgtctatattcactgaatacctaacacattactttattcttaatccggagtcaagagtttcctgaatggatttattcatttgaagttcatatatatttttgaggttagagggataagtttagtaaattattattcaggagcccctacacccttccttgcctctcttccatttaggagggttggctttgtgtttctgggtgctaaccctcctgtaagccccttataattgtagctgcccttcacagcttcacacacaggcttcacacacatgtgttagctcttccataagtgtctctgattggctggttcaatctcattgcctgggaagttaagggagtcaaaatttccacagcctcggtgcttcttattgcattgtatttttctttcaaattaatgggagaaaaagctgaataaggagtttgtgtgctttaaagtgtaccatttgttaatctggaaacctgaatgttgtgagcattggtaagtgacccatggtcacttttaaaaaataattttgtgctcatagtatggtactataccagggatttttagaacaaaaattctaattattacataactttcttattgtagtgggcaggcttggctgaaatgagaactgctgaagcaagacagatagcttgtgatgaactattcacaaatgaggcggaggaatatagcctctatgaagctgtaaaatttctaatgctaaacagagccattgaactatataatgataaagagaaaggaaaggaagtaccatttttctctgtgcttctgtttgctcgggacacatcaaatgacccaggacagcttctgaggaaccacctcaaccaggtgggacacactggtggtcttgaacaggtaagttgtgcttttgagcatgtattaccccaaaataaagcagctttactgatcaaacttgatgtcacagtttttgtaggtcagaaattcagggacagcttagttggatggttctggctcaggatgtcatgaggctgcagttgtatgttcagggctgcagtcatctgaaggcttgactggggctggaagatctacttccagtgttgttcactcatgtggctgtgggcaggaggcttcagttccttactggtagttagtaggagggttcagttcttcacacataggcctccacagggctgcttgagtgtccttacaacatggcagctggcttctcagagtgaactaagcagtgagcaagaaagaagccaaaatgccttttatgacctaatctaggatgtcacacactgttagattgttttctactttttagaaacaagttacttgatgcattccactctcaagaggaggggaatttggctccacctttttgaatgaggggtaccaaagaattgtggacatactttacagtcaccaccgttatctcagcctgggctttattcttcagaggggtggatgggattagtactcttggctctgggaggctacaaataagtgaagtacttggaagagccattcgaagggtcttgtttaatcttggcaactgtagctgcattaaaaagagaaatggagtcaccttagccagtagagttcagcctgctcttggatcttttacagatttgttaagtgtggagttttacacacaaacccagtgcagtactatctctaagccaatatagttgagtcaccacaccttgtgctatctttgatgtgttcattttcctaaaaagtcttaatgaggttttttttattggaatagccaaccgctaaagtagcattaaggctgttcatcaaagtgccaccctcctacttacataattgactcttgtgcctgcttttttctaaaaaggcccaagtgccatgacagatactgcaaggattagagagctgagttagtttccattctgagctgtcctggagtgtgaggtctcttcttctgttattgccaagtgcgtaggaaggagtgtagactgatggtcactgctgggtcaggcagggctgatgatagttattttcaaaaattacctgtactcataatgtgggttacttatgtctcctgaaccatagcaagtaccttgcagtcaaaaggcttatagaggatggtttgcatattagactaaagttagtcttttccgagaccctataaggtctgctgtgatggtgagtccattcttttttttttttttcaataagaaattttcagtttcttttttgaaatacatataccataaagttcactcttttaaagttttgcagccatcactacagtctaattttagagcattttgtcaaaagaaacctcatgcccattagtaaccactttgtcttctttctaaccctaggcagccactaatctattttctgtctcaatggatttgcctgtgctggacatttcatatgaatggaatcatataatatgtggtcttttgtttatggcttatttgatttagcataatgtttttaagatttcatccatattgcaccatgtattagtacttcattcctttttattgataagtaatatcccattgtatggatggatcacattttattcatctgttcaatagtttgatgggtatttggattgtttccactttttagttctgtgaataaccctgctatgaacattcatgtataattttttttatgtgaacatatgtttgtagttctcttgggtatacaccgaggagtggaattgctttaacattttgaggaactgccagactgtttgcaaagcagctgcaccattttacattctcaccagcaatgtatcagtgtcctgtttcaccatatcttcaccaacacttctgactttttgtattggggtgaagttcatataatttaaaattgaccattttaaagtgtacatctcattgacatttagtacactgctggtgaccaccacctatatgaagttctaaaacatgtcacccccaaagaaaatcctgtgctcattaagcagccattccccattatcatctttttggttatagtcattctagtgggtgtgaagtactatctcattgtagttggatttggatttggatttccctaatgactcacaacgttgagcatcttttcatgtgctttcttggtcacttgtatatcttctttggagagaggtgtctgttcagatcctttgcctaatttttaagctggttatttggttttttgttttgttaattgttgtaaaagttctttattctggatacaggatccttatcagacatatgatccattcttgattatctgcttttttttttttttttatttaaatcgaaaaggattggggctgggcccaaagcaggaggaaaaaacgttgtggcttcaccattgctgtgcactgtgggataatggatggaacatggtgttaagccacgtttttcagtgtgatcttcctcagaatacccgtttgctcttcttcccaggttgaaatgttccttcttgcctatgctgtgcgccacaccatccaggtgtaccggctctccaagtacaacacggaagaattcatcacagtctaccccaccgacccacccaaggactggccagtggtaacgctcattgctgaggacgatcggcactataacatccccgtcagagtgtgtgaggagaccagtctatgagagacgcatgctcctgacagcctggcgacgtggcgaagatgcacaggtggctcctgggcttgggctgcaggtttgggggtctctaagaacaatctctgagaagaacccttgggcccctgggagccaagttggacaggatgtcctgaagactagcttttgataagagaaattaaccaagtctttcccctcatctatgatgcaatatatttcagtgggggccttcagagcacacctgttggacggtgcaaaccatatcttctccagaaggcaaatacttttgtatcagaggaaactcagttttggagaggaatatgttctttatatctcaaatcaaaactctctctaatggtaaactggcttctaatttttttaagtacagtatttttttttcccctttagtagtaacgggtttctatagatcttcctatacagtctgctttaactcaggaccttgagattatgagactgacgtgctgcccactgcactgagggggcttctaacagtctgctttaagtggtataattctgggatagatctgttactggcatagtcatgacaacctctggtaatcttaccttctcctttttatgaagggaagagcaatggtttggacttacatcttaattaaggctattttaagcagattgttttgcaacagattaagaattgggtcccaaagtgggttatttcaaggcatttttgaagactggaggagcgtaggagggagtggtgagggaacctagaacttcttgctccttgtgactatgacagatgtctgatgcccccagcgcactggagtctggggcttggtgcaggtggtgccccatcagtgtggacagacactacttgcctttgtggtttagtgttggaagctttaattattctacagttccatagattcacaattttatagccaaacagtttgtatccacctgctttcagaggaggaaccaaaggccaaattactttgaggtagggcttagctggacctgggttttcctatgctcttttcatgctgtgttggagggtgtgtccactgccagatctgtgtaacccgtctgggtcaggggatgagtgacagcaaaccatcttaaaatttttcatgagtacatttaagcggaagcatacgggaatatgagtgcaaaagtgtggctgagccgcgtatgcccttgattggttttgggaagcctgagggaggcagccttcctggctatgagccatcgcctgcccaatcaggctaagggtggtgactggggtggtgaaggggcagctctgctgagcatggtctgccttatggcctgaattgtcctcaaggggtgtggactgcagatggtgttcacatgaaccggagacatcactctttaggattctactggcagcccctgaattggctcaacgtttgtggaggtggtatttccctgaagtactgagctttgttttataataattaaaatccttatttggtccaatttaatatagtttagaagctattttttttgaggcaaaccgtttttgaaaatgtaaattttgtttttaattaaaaataaagtcttagttaagaaaactcaggatgcacaaaactattcagactgttactttagctttctcccattacctcatcagtaatattcaccacattttgctaaatatttattgattagagtgttgaaatcaaattctgctctaaatgtgtgtgaatatgttggagaggctttgtgttcttcactgtgaaatgcaattgtgccttgaataagaaggtacctagaagccaaattaaagtaataatgacttcttattggctttgatttttcattgcagtatatgggattgtacagcaggaaatgcttatcattaatttctgatgttttttaaagcacaactcgaaacatttcgatcatacatacatagcagtagagatctgtgcccttcaggtacattgaatctgaccatcagtttatatatgtcattgaattttaagaatactcatgttaataatagtcatctatccttgcattttgaaactgttctaatcttagtgaacttgaattggatttctgggtaaaagaatgtgtttcttttatgttgcttctgtccgaaggccttgtcagaatctgtcagactcttgtttaggtttagtgtgatcatggcgtcagagaagcaaagctttcaaataaatagtacttcaggaaatagaaatgattgaccaactttaaaaataatttttttttaattgcaatatgcagcttcagttgcccagaatcttagttccgtttctcattcttggtcttgagctggtcaggtgacatcagcagattagaagttgaatggagattaagtggattcaggaggatgttccacttagagcagtcttcaaaatgataaggtgttctagaagaaaggaatgtagtaggaactatactatgcctaactttctatcccagagtgtcttgcaagagtttaggagttttggaccctgtgtattggcagaaaagttatctccatcttaagcaggcatgacttttatacctgtgagctcatttaaggtgcatttaaacctaaaataatttccctgtattatgcttcatgggattaacactgcttttccagaacattttcagattcccctccttacatcctgagctccttctgtatatacatctgttgattttatccatccacaaggaacaatgatagtcacattagagaacaagaaaccagtaatacatggtctctaactgatgattcgggcctggatttgattgaaagtgtttgcagttcctcttccgtagaatacagagtggatgaaaatgttttcaatgcacagaacaggatgaatccttttttctttatttagcgatttacacttttgttactctattatatattcagttagtgtctgataagattttctttgcttaaggagaacggacattgccttggtatgttttttttttttttccctccacttttggagcttatcaggtaaaaatctcaagccacatgaattgttaacacctctgttgggaaaagcctttgtgagtttttatgtacttggtctttgtttttgttattcatcctgtgtcctccctcttcccgatgtgctgttttacctaggagttagtctgctttctgaggatcttttagagagaggctgtgaagtgctgaatcacctttaatgatacagcacttctgccatctcagcatctacataggacttacatagacttcctgaatgtgtcttcttcagatactaaagtacagttggatcattttcttatctccttttcttaagcagtactttgcaggtactcccctttgaaagccagaagcataaaccattggggaatcttaacttgtagacatgcagtaaaagaaatgcatttatgtaagatctgtgagtacttaaaaagaaagccctcagtgtgtgtgaagtgaatgtgaaatgtgtgtgaaatacatagaattcccaaatagtttagcaaaggcagggcgcaatatcaagtaatttaaaaatggtccaaggaactgtaagaaggaggaactaattctagaataaatgttaaaatgccattcaagaacaaaaccacagatgccatacagacctcctgtgcttaagttatagaagaataaaaatctgaatgaatggaaggccttacgtgtatacagtttacaaattcctatttctaaaatttaagtcccttatttaacagaagtatgtattttaatgcttaactgtctcgggaaacctcatttgtgacatcatctaaggggatgggaagactagggagccagtgccacgttgaacagaacagtggtttagtgaatgtgtgaggaaagacatgggcaactgattattaatgtttttgtaattcagtttataacttggaaccaatgaaaagcaacaaaactaaactggtttgacagcctgccacttctggcatttcctgtaagtcactagcagtaggtgtgaggtgggcttgcccatgaccaggaggggtgtgtgtgtgtgtgtgcatgtgtgtatatgcgtgttggtctgcagtcacagcatacctttatgtgcatgtgtcctcgcagcttgggactcagcagtattctgggagggtggaggtgaactgtcccatgtattgtattatatattttttgagatggggtcttgctctgttgcccaggctggagtgcagtggtgcgatctcagctcactgcaacttttgcctcctggttcaagcagttctcctgcctcagcctgccaaatagctgggattacaggtgtgtaccaccactcccagctaatttttgtatttttagtagagatggggttttaccatgttggccaggctggtctcgagctcctggcctcaggtgatccacctgctttggcctcccaaagtgctgagattacaggcgtgaactaccgcgcctggccccatgtattgtatttttttcaggttatattgaaatctactaccaggaatgtcggaatgggttttggtatgtataatggaaatagatagagtggttaagtctagaaacacatacattaattgtattgaaatgttatatcaatacatcatttatgatgtgtgtgtggtcccagacctcatggccaccagtttgtttaagcattgtgaatgctttttaatagcattcattagcattaatggaggaggacactgtgttttctcaattaatctcattgatttgtttggtataagtttgggtcagaaatgaaactgccaaaacatcgatcagtacaaggaagggacacagggcttaaaatgtccacagtcttggcagtggacttggcagttctcccagtaagcagaagtacttgagcttaattctgaacttcaaagtaatattttatacttaattttaggagttttcatttacatattgaaaaatgccttgactgtattcacataaatggtgctaaaacattgtaccccttataagaactgcagcaatccacagtaatgttggttacttctgagtatttgataaaggaacaaagtcaaaatgaatgtatttaataagcttctttctcatttccattgtttttataaaaatattttggtattgttgcctgcattttagccacttctaactttttgtattatgaatttggagaggataacaagccaactttagaccctctgccagtggcgatggtgtttttcttccatgggtaagccattgtgaatggaggctggtggagcagcacactgtgtgaacctggcagcgctcatcttggcttgtttagcagtgcctctgtttacaccataagatgttccgcatgtgtccaaaatttcgcctgctctgaaaaacatgcccccgaggctctgtgcagtttggggccttggttcccacctgcagatgcggtcagttgcctggctcctggggccagagtttcctctgttacttgttgagtctcttgtcttcactgtcagaagctgaactgacttgggggctttgctgttgatccactttagcaaaccctgctgcagaggactgtaaaaacaaataactaaaaataaacttagaaaatacaactcagaagcctggctctgttgctgtggtcaaatgcttgcctttgaggactttggcagattgtgctattacattgggctctaactttctggcacccgcaaggcagacctatgatgtccacatggctgactcttgacccctggccattgtgagcagaggaatcaagggtttagggaggcagtattgggcagtgtggaagagttagatgagatgaagcagttagcacagtgcttaacccatactaagtgcccccaaccctgccagccaaattaggtgcatagttttcagcttgggtctggattcaacagcattcccgctgcccactaaaagggtgggcttggacagttcctgaacctccctaaatctgtttcttcatctttaccacacacagtctgtctcagtggtggtgtggattaagtgaggtgctagcacttattaggggaagatcctccagacctgcaaagcagggctgcagccccaattctgacccagccctgctgtgtgtttgccgcaaagaggtttggtgtgtgcgagacatttctttatgaaccatttacactgctggaaatgtacccactaatgtgatggcaagaacttcaacaaattgcttatgaatcaggctctcaatggaagaagttaatcctctgaagagggggaagactggactttcagaagtatgttggggatagagaatgaagtttgagtcagcagagctctgccttcctgtttgtcaaagaactagagtctgggagtcttgcaagatggagctgggcttctgaagaacccagtgggtaggtactgggcatccattagacggcagtgctaagtcggtcatgtgcagcagaaagacctccccactgtgaacaacaaaccactttcctcctccagtggcccattcatttggattgatacactttttcagtgtcagaaatgcactttctccctctacttgtctgaattacgatgctctgctcaactctgtggacagtgtttcttgaatttccttttccaccgccttttcccactcaagaaagtggagagaaaaacagggatgcaggctgtgggtcttgtggaagccctttacaaccattaaataaagaacaccagctgcattatgtgtgtttagaacgagaagttgtttgtacagtatttttctattgaccgcttccgtcttgcctgaaacctgggcattctttctgtagtttctctgaattttctgtctcacctcctcacccctacccttgccttttgtctgggctcggttgcctgttcatgttctttgcctctgacattaaactctccctagttgcctgtgtgcttgagacgtcttaacaagttgtcctctaagtggtgccattgatgtacagtcccattggagagcacgagtatgtttccttaggctcttacaacactggctttatcaaacattttgatctttgctgagctgatggttggaagtctgacttgcgtttcttgagaaaggctgagcatgttttcatttgcgtaaaccattttcaggtcctttcctgggagccatctgttcatgtcttctgtaaccacttttgagttttctatctgaatttcacagaaacgagatagatgtagggtgggagcagtaggaaggaaaggcggaccaaggggtgttagagattccatgtcaggccctttggttgcaagtaacaataactcactcagagtattttagttcacaaagggtttggccttcttcagggacaagaagagagcattgaagaccagaaggttacgggagggagggctgtcttgctggtgtcctagagttggcatgttcagggtaggaatatgggaatgcctgcatccattcaccaaagagtgccagccctggggccaggcatggttccaaacttggggatgtaggggtgagccggccaaggcacagtcctcccagccctctccatcctcaccccaaccccatgcccaccctccccaaccctccccatccataccctctgtgctcaccctccgcatctgcacctccccctttgcccaccctccccatctgtacctcccgctgtgcctaccctccccagccctcccctctgcagccctccccacctttcacggagctcttgtgcatttgtcactggtgagcagaactggcatgtctccagggatggaatcacaaagtaactatttttgtctttggctgtttaagacataattcaatcggagaccttctcctacccctggtgaaaactcaactcagggcgacccatcacctttttgagcactctggggtaatagactttatagtcctcttaggttgccaaatgctttcctaactcagaaattggaatatcgcatctgtgtgagagtgaaagctgtgacagttgctcactgccctgtttggccctccagagttagaacaggaggagggagccaagacagggagggagcagagatctcagccctccataggaattgtcctgtcggccgcccttcctgggctcagccagggctttgttctcattctctcatggggtactttcaggaatctttgaggccccctctgtctccccacttcttgtccccggctcagggccttcccatgtaccttgaccaaggcagctcctgggatgtgctaatgctgtcgcctcccaccacaacttcctcctttgcagctcgtaggaagccagtgatagctccagcttctttctactgagccctgtccacacccctaggtggccttgtggggcaggccttaagatgaccccaggcaagcttgttgatctatgaggccagggtctgggccaagggaaagacttttggaccccctgccctgtcaaactcgggatttgccagccagccccaatgcccttctattagatttgatgggtgagtcagacaccagcccactgagtccccaggactcaggaccccatttcaagctttgagtattacaaccccctgccccagaaggagtgggactcagtgtcgctctctgcaaagaaaccatctctacaaattcttttcaaatatctactcttggtacttttttgccctcctcgtgttgagggatggcagagtcagggagttcagactcctgcagaaggaggccgggtgccatcaggagtccccgtttggtgtggccgccttctctttggtgtgagtgtcgtcctctctggctgggttcttattttctacatgtagctcaggcgtaagctggtgcccacccgtgttaagtgtcaggctggtcctgaagcagcccagtgcctacagtgaggaaggacctgccgggcaaagcagggcgctcatcaggccagggtttctagaaccatatcccaggctgctgagaatgggtgtgtgggttgtgtgatgcagaattctaggagatgtcatttccatcatagtctagggaaacactcgagcctcgtggagggagatggttctggagggaggcttctgtagcatccaagcccaaggtgagcaggagccccctgagccgagctgctgggactgaagaggaaaaggagagagtgggagtgagatgctaggaggcagcgctgatggcgcttggggacttgactgagaggagtgggacatggagtgggtttccgggtgggtgctcctgtgactcctctagatgggggagacaggagaaaatgtggaaggggtaaggaaagagtatacagggatgggctgaaggccacagcccttctcggcccctggggagatgttgggaggtgactggatacacccagtgactggtctgaagcttgggaacaagttagggctggaaaaacagacttgggcatcaccgctgtatttggagctggaaataggcccagattaggaacctgggcttgtgaggactggattcccagcgaaggtggaattgggcctgccagccatttgtatacttttctgaagagcatggaattaaatagcattgggcaggttggcactgggggaaagaagaaccgggcgaggttaggacgtggccttgctggcatgataaaaagcatgaggaaacgctttttacctcagaccacacgtgaattgcaagcagctgccctgatggtgccatcaggggcggtggagatacaggccgctctcctcagccatttcctttagaccaagagagcttttattgtgtagcagatgaaagacccgatgagaatttgaggtgtatagtataatgtaaagtttggaaataatgattgtacttgttaattctgtattggtctttggaatcaagggtttctgaacctgagataagcagcttttttgtttcataaaagctctagtcatttttctgtgttgaaagtggaccacagtaatgttcatggatttgttggctgaagcacttccatgtggcttagaagcttagcagacacggcacctccgcctttgtgaactgtcattggccactctgcaaatcctggtggtgcagtagtttagaactgtgtag

SEQ ID NO: 2045 - DNA, 1207 bp, Homo sapiens
ggccacggtgacgcgcgcggaagcgctctgcggaccctcggaaaccgccccggcggctgagaggctgcggccactgcctggcaccccgacgggaggggctccggatcgttcggagccggctgaaccccttcggccgcgagcgaccgcatgagtcgggggactatgccccagcccgaagcgtggccaggcgcgagctgcgccgagacgccggcgcgggaggcggcggccacggcgcgggacggcgggaaggcggcggccagcgggcagccgcggcccgagatgcagtgcccggccgagcatgaggaggacatgtaccgtgctgcagatgaaatagaaaaggagaaagaattgcttatacatgaaagaggggcatcagaaccgagattaagcgtagctcctgaaatggatatcatggactactgcaaaaaagaatggagaggaaatacacagaaagcaacgtgtatgaaaatgggctatgaagaggtttctcagaagttcacctccatacggcgagtccgtggtgataattactgtgcactgagggccacgctgttccaggccatgagccaggctgtggggctgccgccctggctgcaggacccggagctcatgctgttaccagaaaaactcataagcaaatacaactggatcaagcaatggaaacttggactgaaatttgatgggaagaatgaggacctggttgataaaattaaagagtcccttactctgctgaggaagaagtgggcaggcttggctgaaatgagaactgctgaagcaagacagatagcttgtgatgaactattcacaaatgaggcggaggaatatagcctctatgaagctgtaaaatttctaatgctaaacagagccattgaactatataatgataaagagaaaggaaaggaagtaccatttttctctgtgcttctgtttgctcgggacacatcaaatgacccaggacagcttctgaggaaccacctcaaccaggtgggacacactggtggtcttgaacaggttgaaatgttccttcttgcctatgctgtgcgccacaccatccaggtgtaccggctctccaagtacaacacggaagaattcatcacagtctaccccaccgacccacccaaggactggccagtggtaacgctcattgctgaggacgatcggcactataacatccccgtcagagtgtgtgaggagaccagtctatgag

SEQ ID NO: 2046 - protein, 360 aa, Homo sapiens
TPSAASDRMSRGTMPQPEAWPGASCAETPAREAAATARDGGKAAASGQPRPEMQCPAEHEEDMYRAADEIEKEKELLIHERGASEPRLSVAPEMDIMDYCKKEWRGNTQKATCMKMGYEEVSQKFTSIRRVRGDNYCALRATLFQAMSQAVGLPPWLQDPELMLLPEKLISKYNWIKQWKLGLKFDGKNEDLVDKIKESLTLLRKKWAGLAEMRTAEARQIACDELFTNEAEEYSLYEAVKFLMLNRAIELYNDKEKGKEVPFFSVLLFARDTSNDPGQLLRNHLNQVGHTGGLEQVEMFLLAYAVRHTIQVYRLSKYNTEEFITVYPTDPPKDWPVVTLIAEDDRHYNIPVRVCEETSL

SEQ ID NO: 2047 - DNA, 68497 bp, Mus musculus
  misc_feature (1)...(68497): n = A,T,C or G
ctgtgtagctatagctgtcctggaactcactctgtagaccaggctggcctcgaactcagaaatctacctgcctctgcctcccaagtgctgggattaaaggcgtgcgccaccactgcctggtatatctcccttttcttgactccccaaagtggtgggcacccagcagcacgggggcctggtcttgtgccggcctatcacctgatatctggtgtatatgtcaaggactgaggactccctgactcggctcagtctctcactgttgaacagcctagtgaacgaagcgtctgctggtctgcctcttcctctgtctggatctggatctgacctgccatttccttctctggactcagttccgttccagctttcacctggaagctgaactctgcagcttcaggagccatctctcctagcactggtcaggctcattatcttatcaataccaattcctgctcaacccactttaccctcttggcctcagctacagcctcttttgacatatatgtatagagctatataggtctatttgctgtgtgattaacagagttaatgttcataactaaaattaggataaaagaacttacattggccttagccaggcaactactagtggattttatgacaaattattgctatctaaacttctaaacctggtaaatttactgtcattcaagtaacttcaacattgtacaagacacaaaaacatgttcgtctatgcatttagcttattgtgctcatgataacaggaagaaacacctagtggtttggcaaaatttagaggaattaaagagggcccagccaggacagtctctagaagtagggggcaagaagtaatttaaaatttagggcagagtagggtatggcaacaatctctaggaaggctgaggcaggaggatcaagaatgtgtatacacagttaatgaaaaagaagccatggatttgaaagagagtggggaggggtatatgggagggtttggagggaggaaaatggaagggagaaacattgtaataaaattacaatctcaaagactaaaagaaagccaggtctatagagagagtttcaggacagccagggaaacacagaaaaacgctgtcttgaaacaaacaaaagaaaaatctatttggatacattgaatttatttttatgttatatatacattattgtaaatatatattaagatttttctctctcagcttgttgaaaggagaggatgatataattggtcttcagatattgaacaatccttacatacctgtaataaatctcactggacatagtatacttttttaaaaaagaaaaagaattcatagatatcccaagctaataacaaaaccctgtctccaaaagccaaaagagaattttgtttaaaaaaattaaagattaatttattgattttatgcatgtgtgtatgtgcaccatacacatgttttgtacccttgaagttcagaagaggacatcagatttcctggaatcgaagttatagatggttgtaaaccaccatgttggtgcagtataattgaacacttatactgcaagtataagtgcagtgagctattgatccatttctccacccttccccgccccccgcccccaaataataggttggggttgtgtctcagttggtacagtacttgccttgtttgcacagtgccctggttcggtccccagcattacataaaacacagcatagtgggatctggacaaatggccttgtggttaagagcccttgctgctcttccagaggatccaagttcagctcctggtacttatgtcagaaggtatagtgtgcagtttctactaccccactttaagctccaggtggacagtgctgccagcctctgccctggtcccctttatctgcaggtgaaagacatacatacattatcttattttttgagacagggtttctctgtgtagccctggctgtcctggcactcactttgtagaccaggctggcctcgaactcagaaatccgcctgcctctgcctcccgagtgctgggattaaaggtgtgcgccaccaccgcccagctatcttatttttaatttgttttttagtttaacagccaggctcttttaagcctactcccagatcaacacctctaattctgccctcaacctagttgcccagttaccttctccttgctcagtaccctaaatctaccctcagcttagttgcatttctttctttctttctttctttctttctttctttctttctttctttctttctttctttctttctttctttctttcttatatgtaagtacactgtagctatctgacactccagaagagggagtcagatctcgtgatcggatggttgtgagccaccatgtggttgctgggatttgaactcctgaccttcggaagagcagtcgggtgttcttacccactgagccatctcaccagccccttagttgcatttctaatctcccatctgctaccccaggcccagtcagggaagtggccaatgaccactccaccctagatctcacatggctggtgcctctctctctctctctgaaacatggttaatttcttcctttccttgattctcctaacctgcctgcaggagcctggaagtcctgcctctgcccagccactggctgctagcatctttgatccatcaagaaccaatgggggaacagggccttcagtgttcacatgcagattcccaatcaaagcctcagaaccacgccctacaagaaggttttcaaccagggatgcaacgccctcttctgatatctttatataactgcacacatgcagtgtacgtacagagtcacagacaagtacacagtcataaagataacactacatcttaagcaaaccatcagttgaggtgaagcatgcctgtaatctcagcacttgggagggagaagcaagagaggataggtcatccctagctatctagcaagttctaagccagccctggatacttgaagattctataaaaaataaacaaaccgaaagatacacaaacaaaaaccgtaagtgctttgtaattcagctctctgattcacaacctagcctaaaagagggaacaatttctcttgggatttgaggcgttagtttttatctaatgagggaagtacaataaaatccatggaaaatcagacctcctacactccttcacacctacacctacacacacacacacacacacacacacacacacacacacgccaaggactaaacaaagacggttccaagtgaaaagatggcactgggcaccctgtaaactatcatcaacaggttgctgaatgaaaacacggactctttctgaggaacaaagaggaatgactcaaaggagtagctgctttctgagccaagcgtgcagccaccagcagaaagggcagaggtaagagctgcagaacaacagaattgctgcctctggaacagagcccaggggattctccaaaggaacatgattggttttcagattttctaatggctgttatgtgcttctaaataacttcttcctaaatgggagtttcgattgtggtttgcctgttgtctgttttcccattatatgctggatgtgggagaaagataggctacagaagagtccaaatataaatgcaaatagtgttgtgaacgcttgagagtaagtttgatatgatccatattacccccaaatccttattacacttgatcttagccaaaaggcccagaagcgatccaaatcctttttaagaaaataaaattcttaacaatttcagactcatgtataatggattttggtcatttttcacggctcctcaccctctcatgcccctcccattttcacagaacctccccctaagttcccttctacttccctgttttcctgtctttgttgtttgtttctgactgctgagtttaattaatgggtatgggtgtgtgttggttcttggaacataggcaacttactagtggctataccagtgaagaaaatgtattccaccattacctccaaatctttaatataacaatatagtgatatatcatttattatgcatttattataaatacatataaaatcataaagttaacattgatacatgattatcaattctgccctctgtcctactcagtttcactatagatataaatactagcctcgagcagtggtatgtttagtcgtcctttctcttaattttttttttcaattagaatgggaaatgtttttccagattttcttctctatcatgagattgacattttggaaggctctaggaagtggccatcatttggattgctctgtttcccttggaaattattggtatttcacagagtagtactttgaaatcatgtgtcctttaccagccttccatatgcttattcctgtaactatggactcatggtttccagtcctcagctgataaggagttctttctgtcaacctttaacttgatgcttatctttttctgtactctttgaactttgaaccatattctggatccttttacatatcttcagctttgatttgataggattcatcttccttttctggcctaagagttttcagtcttataattgttctggtctatcagagttaggcttctctcctaaacaccctgtcctgttattggcatgttccaggtcactaaatgtactcatcactttggttaaatttctgcttccagacattcgcccctgccctcctcctcctcctcctccttcttctgagaaagggtttctttacataaccctggctgtcctggaactcactctgtagaccagtctggcctcaaactcacagagatcctcctgcctctgcctcctgaatgttgggatttaaggaatgtgccatcactgcccagcatcattataggtgtcagcatcattcctggtgtcttagttagggttttactgctgtgaacaggcaccatgaccaaggcaagccttataaaaacaacatttaattggggctggcttacaggttcagaggttcagtccattagcacggcagtatccaggcaggcatggcgcaggcagagttgagagttctatgtcttcatccaaaggctgctagtggaagactgacttccaggcaactagggtgaggatcttatacccacacccacagtgacacacccatttcaaccagatcacacctattccaacaaggccacaccttcagatgatgccactccctggtccaaggatatacaaaccatcacacctgggatattcagtgctgaggatggaatgaagagcttcaagcactgtacctactgagctacatcccagacctgtattcacatcccttcatttttcttttccagatagggtctcatataacccaggcaggtcaggaatccatcagacaattcaaaaccttaaactctgaatcctccttcctccacttccggagcacggagactacatttaaatatactacacacgatttacaacatacatttgctgatgtctcttatcagtttcattctctatctttaacttgaggggatggcaggtgcagcacacagacttagcatgtgtgaggttctgggcttcagataccagcaatgcaaaagtagtatctcttaagtgggaagtcataaattcgtatcaatttcactgattccaagacagtatcgaaagatttgttctagtttttgctctctgcatttacctccagtaggcatagacttggagactcgagtagctttctttacttacacacttttggggcttctttttaaaactgtctgcctgtatgtaacggtggcctttcctcccttgggcaacacaccctgatttggattgtgagcatttgcattgtgtcaggctgctgctctccttatccggctcagtccccctcatcctggttggattttgccctcctgcttatgccatctggactacttaccttgtttcactctagtgacgtccagactagatttctcagaagggtgtgaagaggaactattttatagttcataggttcctgaactcgagggactgtacctggaactggtttagatgatgaaattttgcacttgaatgggctttgggggtggaaggggtggagagtggaggacaggacttggaaccttatatataaaattctatatatattgtgcacgtgagaagaatctaaaacaatttgtagctacgggaaaaactggtacatttaagatgtctgtaaaattagtgctcgtcctacatccatcaagatgtctctttcttccttccttccttccctccttccttccttcccttctctctaaatttcaactgcccagtaactttcttgttcattttgagacagggtcttctatagcccaggtctagactggaacttgctatttatttaaggatggtcccccctgcttccacctcccaagttctgaggttacaggtgcaagtcaccatgtctaactttaaattagttatttaatttttattttttaattttgagacagagttttaccacatatatagccttgactggcctcaaactcgaaattctcctgtcttcaccttttaagtgctgctaggattacagttcgtgtgaccatccctagctctgaaatttatgttaatcaaaagaattctctaagaagtgatattttggggaccaacaaagtggctcagcaggtaaaagtccttcccatcccaacccaatgatctgaattccctcctcagatcccacagtgggagaactgacttctgaaagttgtactgtgaacttcaaacacttgtgacatgtttgcacacacacacacacacacacacacacacacacacacacacgtgataaaaatgttaaaaagaagtggtttaaggctgtgtcttaggaaatgttcctctgtttggggacctttttggaacgtgttctccacattgtgaggaaaacctgaacagttgccaggctaagtcattacatggaaaggcctttggggagggggtcgagatggaaggtctcattactcaacctagctgggccctatgagctcccagcctctactagcaccgatttccagggcacacacaagagcttggagaagcactgtgtgaaggtgttttgaaatttgcaactgtgctagtgccgggttattactacgggaatcagaactgccagccgaggtggagaactgctgtcaagctgcttgggagttgggagttatagacctgtgaaataactgcctgctgtgtgccaggtactgtcctctgttctcctcatctactggggtgtgacagcaatgtaaactggcaggcataaaaaaggcttagtccttgatgggttctttgtcatcccaatcaacagacaatcagcaggtgttattccccccccccgcccccgcccctatttcaggccgaaagggttgtgggatatatctgtggccctagcactcttctcctgtctcctggccatcatctgtagctagaaagctttgtctccattttcctctgctcatttttcagatgtggagctcatgcctcagcatagctcactcccaagcaaaatttccctgctagcataggatggtggagtttgttctttaccctgaccaactctcagaagataattcttgactttgtcctctacaatgacttagcaataaaggtttcctttttcttttcatatactgagataaccatttctgggatctaggtgtggcgactcatacctacaatccatgcccttgggaggctgaggtagaaggttgagagttcaaggccagttaggctaacctaggctattagggtgagctcctgttgaaaagaaagaaaagaagaaggaggaggaggaggaagaggaagaggaaggaagaaagaaagaaagaaagaaagaaaggaaggaaggaaggaaggaaggaaggaagaaagaaagaaagagagaaagaaagaaagaaagaaagaaagaaagaaagaggcaggcaggcagagggatgctcacagatattcctggtcatgataatggaggcctacttatagtgtcagatttgtgaggttgaggcaggaagatgccaagtttaagaccaccctgggctatgcagagagaccctaatctcagaccaaaccaaaccaaaccaaaccaaaccaaaccaaacccaagtaggttgtgcagatttttcaggagttatggggtagtccaaatgggtcttttccagaacaggttttggtgttggggaactggaagaacaataacgcctctttctgagggggatgaggacgggagtgggatggaggggttagattactgtgtgcgggactcatttggctgagatgatactggaaggtggagggttagggaagagatgtgggttggatccacaaagttttgtgttatcagcttatagataatagaaccacacctaaggaacatagacataaaagagccgcagggaccacagcctcaggacctcaccaagggaggcgaggggccagagagggtcggtcaggaagtcacctgatgagcagtatactttcttttctttctttctttttttttttttttttttggtttgtttttgcttttgtttttcgagacaggttttttttctgtgtagccctggctgtcctggaactcactctgtagaacaggctggcctcgaactcagaaatgcacctgcctcccaagtggtttttttttttttaaatactttctatgattgcaaccaaatgtcactcagcctgctttctcatcgatgaatcggagacagttaacaacccctattacatggcatatattggttaacaacaaactctccaaacataggagtagctagaattagcattccccatcttaaggttctcatcacattcaaggataaatgggtctgaggcctcggggtcaagacttcaagtgcttaaatcttccagcttccactttcagatcaacaaggttaggtaaaggaacgcgcagtgacaaagtttttaggagccctgagttccacagcttatcagctgtgagattttacaggccattcattcttattcactccaaggcactgaaatctttgtttactacatagtctgggctggctccaaactctggctcttcctgtctccgcaaccagagtctgggattacaggtgttcacgaccgcgcctagattccagtattctgttaaatggggactgtgttccagcgctgtgtacaacgggctgttctgtacgcaggcttaggaattaatgcagttttctgccagtctcatcccaacaagcatgtgtcatctccatgtggcatgcactagaggccatgttgcacctagaaccaagttgggcaggttcctgaggtttcccaatcctgcaaacacttatgtgggagtaagagtagagcaagatggtcacttccctagcaggactcaataagcagctcctccactttagccccctcacaggcaggcggacccagctagggtaagtggatctttggaacgccccagagaatccgtccgctggcctcgcgggacgtcgaagccggtttcctagacgacctttctccactccattttctcactatcccaaggctaccgcctgtcctcttgtcctcactagctgctgtcccaggcccatacccgagtcactgggtacgtcaggaagtggtgagcagctcgttgaacaagaagctggtttagagagacttaagctccacggtgaacgctaggaagaaaagctgagcgccgctgggtatgggatgcccgctcaacccaaggctgcggtggggctggcggagcgccacgtttagtccccaagtgtcgcgacgccctgcaacccaacctcccgagggcccgccccttagtgcctgccccccaagctccgccctcccttagctgccagaaaaacccggctgaaggttccgcccctcagtcccctctccgagccttgtccctcatgccccgcccctctcgaaaaagacccgctttgcggccccaccccttagactccgcccccccaggttccgcgaacagccttccgaaacccggttgaggccccgccctaggtcgagaccacgccccctgctcatccgcgcttgtggttcccgctgatctctccaaagtcccgcggccaggggtgtcggctttccgccgcaggcggccggtgctgcgctaggtcctagccccctccccccggcccctccttcgatcgctgtggtcgggtagcgcctggcgggcggcctgcgggcgggccgtcctctcagccgtagcccaccccctcttaaagccgcggcgggaagatgaggtttcgtgagcagttcctgggcggcagcgccgcgatgccgggcgcgaccctgcagcgggcctgccgcctgctcgtggccgtctgcgcgctgcacctcggcgtcaccctcgtctattacctctctggccgcgatctgagccgcctgccccagttggtcggagtctcctctacactgcagggcggcacgaacggcgccgcagccagcaagcagcccccaggagaggcagcggccgcggggtgcgcggccgccgcctcctttaggcgtctccccgaagcctcgcccgggtctcgactccagccctggtgcagcttctggccccggcttgaagagcaacttgtcttcgttgccagtgcccaccaccactggactgttgtcgctgccagcttgccctgaggagtccccgctgctcggtaagacccaggatctgaggacgtggactcctcggatttcctcagtagggttccagggatattatcctaagatctctttcaggactgccagccaccaggttttgatcagagtgcataatccccaagaagggcttaatcctctttgggatgacccaaagagaggttggctggtgtctcaagaggcaggggccctgttgggaaacccccaggctcttaccccagcaccagacaaggccctggagacacccttgttctggcccaggactcaggaagtttgaagttggggtcagtttagagtagactgaaaaggctgctctgcaaccttccctacctatagtagcaacaccggcaaccttcaaccttctgaggacaagaccgacagtggagaaaaccacctcccctccccaccaccctccactccgccttagaacaagccacttaactttctctttaaggtttctttctggtaaatggagataataaaccacacgtattttggagttgttttgaagaagtaaatgaaacattgtaactaagagtttaaagaatgaggatgaactcttagaaagttgctacaattgtgggatttcctcctgtttgtaggtgctgaaccaaggggccttctgtctcccaccccaagttcctcctcctgatgcttcctcttaaccaaactgagcagggccctctccaggggcagagggcctgtgtactcaggggactgactggagggctaaaattaacccggtcaatggggctgcactttcctggaaatacttgcccagctgataccaggcaggggggcaagtatatgagtttgtgttcccagtactaggcgactggccagggtagaactttgactggagatcacaggtagtgccaggttttagagaatgtttcgcagagtgaatcccatctccccacagacagacaggcaggcagcgtgctaatagctctgtctcattctgggaaagccttggcagagcaggccttcctatagcctgttgctcaatgtctccaataattacttcaatgttttcacatcaagtttgggaggaacctcttggaattggccaaacatgagtaatcgaattactttggacttggttgttaatttgggaaacaggaatagttctatggaaagtgaagtagaacattagtctgacttcaagcatgttatagtgtttcttcctgttgtataaagtggacttgtctgtgcttacctcacagggctatttttaggactaattgagattgtatatagagtaggcaggcactcagcaagtaatcaacaatacagtttgaggatgtgaagtggcgatttcttagacttccacggagatggctcgctgaacaacatagaagaggaggaagtgaccgagtcctcagaccacagaatgtctgggccttttgcttttatttttggttgttgcctgagcatcatgcagaaaaaagacaaattaattagttaagtaccccagagccatggacatagctcagatggtggaaggcttgtctggcctgcccaaagccttgattataaaactgagcaaacatcagatcctatctcaaagagaaaaccaggtttatagttgttcagagtataggttcttcctgctgaaatatgagggactgtggtaactatagttctgttcagtttggtttggtaatgtgggttgctcaattcatcctgaaatagacagctcaaaaggaccttactgagagagatcactttagactgtggagtccagaggcctaggcctcttctggcctggctaccttcatgtgacttgcatgggactgatgtctaggtttctgctgagaccacaatcgcagaaacaagggtaggaggttaggttttgttttgtttttattaatttgagcccttagatttgaatgcttaggtgcagcttttggggggcggttcttggtcagaaggaatcttaagaaaacttttaagtgtatttgggactctgtgtgtgtgtgtgtgtgtgtgtgtgtgtgtgtgtgtagtgtcaagcccatctgttccactgggcaggtgtcagccaaagcccttgaccgtggttttgaggttggtgggagaaagcacccctagggggttagcacggtggcctttttactactcacagttcctttccccaactttcctctgctttctggtgtccagcagtctaagccagatgcttggatctttttcagttgatagctggtgactttgaggtggtaagggaccagacccggctgctgataggttgctgttagatctgcttttgggtttgtcagaatatttgaatggactttagatagactgaggttggaattgtgcttaggcaatatatgtgtaaccggggcaaactgtattgtttgcagtcctagtgatggtgggcactcctctcatctgtagggctagtgtgagcctctgtctgtctgtctgtcccatccttccttactccactgtgggctacaggggttagctggccgtgcctgataagtcttctatttgcccagagaactctagttacttcaggcattttctttagccctgtgacaggcctccaggtaactgtcactgtgtactctactggctgtagcagtgagccggcctttctggccctctgaatgtttgcccgggctgagaggaggcatggccttgtggttctttcccggaatgtttatctttttccagaaggttttatctgctcatatttggcacagcttgacaaaatttgactggctgtggcacaggcattttgggtgtggtgttagtggaaagggggacagcacgtcaggctggattgatttggggaagcaggactggctgattcagccgggggtctgggacagatggtacagatctttcaagggggcagtggacactggacaacttaaacctcagaggccccttttgaccaactgtgctttaaggagatacccttcatttgttcaaagggaagatgtgtgtgtgtgtgtgtgtgtgtagacccatatgccatggtgtgtagacccacatgccatggtgtgtagacccatatgccatggtgtgtagacccatatgccacggtgtgtagacccacatgccacggtgtgtagacccacatgccacggtgtgtagacccacatgccacggtgtgtagacccacatgccacggtgtgtagacccatatgccacggtgtgtagacccatatgccatggtgtgtagacccatatgccatggtgtgtagactcatatgccatggtgtgtagacccatatgccatggtgtgtagatccatatgccatggtgtgtagacccatatgccatggtgtgtagatccatatgccatggtgtgtagacccatatgccatggtgtgtagacccatatgccatggtgtgaatgtggagctcagaggtttcagggacaggactcacactgtcaggcttggtggcaagcaccttttacctgctgagccatcttgctggcccaggattcttatctagaagcaaacagcccagttagagtagagccctgttcatgagcccaactccctggcttttgggggctacttttagctgagcctctgccatggaatgtgatggtgaagatgaaatacttactacgtctctgctgggctcttggctctcaggcattcctctttatcatgctgccaccttcacccatttgtgcatgtgcagacacaggcaggctgattagaacagtctgtactgtgaggctcggaagagggctgtcctggacctacccattctgagatggctcttgggactctagcaccctctgctttagggtggaatctcatcctgggttttagaggaggcacagagatcctctcttggacgcagatcttgcagctttgactttgggtaacaagccagtttgtcttgctgcttttctctggaggcaataatttattgattacacacagatcctactgtcttttatcttacagtcatattggacataccctttcctacccggagcagagatgtacattccagtaaaaccattacaaggtctcagctcttcccaactcagtcagtcaggtggccgtaatacggaaacctgtttgccaaggtcattgagaaataccctccatgacagtctgggtctttttcatggtgaaacctgttaatttcttccaaatagcattatggcaggataagagtgatccctgacagttatttattctacactttttaggggtgtgactaagtggttgcatatacaaggccttgggcttaatccagcaccagggagaaatatcccaggttctgaacaagtgtgggaaccccctgtggcagaagaacaggtagacagtccttgggacatggaaaataagagccaaatgtgggattggctttaaactctagtttcttggcttagcatccctgaagaggagtctggtatttttgcctcaggttaatgtccaaagagactagttcagaggaccaggaattgtcatgatatattctagagattggaaagaagatccttctaagttatgctttcgtatcccttcctctgataggtcttatacggatgtctggacgactgcggtaacatcattcatttacagtgtgtgctgtgtggagctagaactataaagaaaacaaaatgtcttccttgtagcaattttcagtttaagcaagagagacttaattattgtgctaatgtctctgaacaccccacgtgtgtgtgtgtgtgtgtgtgtgtgtgtgtgtgtgtgtgctgcacacactcaagagatcccatgttcctttctctaatattatatcctaccttcctttcattcagaaagaaactcaggcttgatgtcacagttcttccgtcctggttttatttgattgtgtgaaaattttccttttctttccgaagccatacattagctgtgctgggtaatcttaacttgctgcgctataatgannnnnnnnnnnnnnnnnnnnnnnnnnnnnnnnnnacttgctgcgctataatgattataatgagatatcgcccgccatctgcctgggtattatggtctttgagtggcagcagggtagggatttccaggctaatttaggggttgaggatgatggggcagttgatgccaagtcgctcggagccctcccatagattctgccctgggaccgttcagacactggatcaccttgggctcagtgggctaagggtccctgtgaaagcaacctagctattatttttggtcaaacctggtgattccttcatgtctcagttatttatggcctctgttctttgtcccctgtttgttcctgccaaaggagactggaaatctgcttgagttaatgtccatttgaaatttgcatggtttatgatgcagtggcgtggtaagttttttataagaaaaaaaaatcagtgtgtgtgtatgtctgtaggcatgttggccatggtcgtcttatggaggtcactggacaatttcaggcattagtagtccttgccttccaccttgtttgaatcagaatttcttgtctgctgctgcatacaccagcggaacctgccccatgagctgttcagaattctcctgtcttcacctccctatctccctattaagagcactgggaatatagacatactatggtctggcttttacatggggattcaaattcagggtctcatgatttcacagcaagaacttcacccactggaccatctcctcagctctggactggtcttaagacaaacagacttcccttttggtcctaaccctttgagactttggcagtgtgatgagtttacatttgatcctgccatacatgatgtgttccctgagccagtggccagtccctgcaacgttgctcggtttgaacttcatgatcttcatagagctagccttcctgtttctaaacagggcaaagtctcctgaaagctgactgtagctgtggctgaaaagaccttggttgtgaccccttgtgtgtctgggactgtgcagggtgaggtgagggagcctttgccccaggagagagctctctaaagcctgtttggaaagctctctaggttagaggcctgtagtggtttggcctgaggtagttctgggtgaatgtgacctaaagggatcggtcactagaagacagagaggggtgagtcacgtgctaaggttcaggttctgtttcagcttggcttccttatacaaatgagggccaggggctgtatcttttattgggtgttgttgaattctgtggcagtgattttaagtacgttctgggtctattgcgtaactgtaatgatttgcctcttaggtattaggacaaaggctatgggttttgtatttgcctttttctttgtgagggtgttagtaatcttaatttttgtggaaagtaatatggaatgggagggtataactcagtgtagaacacttgtaggtaagtcctaggtttggtgatcttcaactctgaaaacatgcaaatgaaagccacattcttttcacctaagataagcctgccctcccgttttctactcgtcttcccttcttgtatgtttaagaaaagaatacagctgataacttgttcctgggttgttttattttattttatctggcagtgtcttgcaaggtagcctaggcttttagctcctgcctctccgtactccgtgtactggctagtttttatgtcatttgacacatacttgagtcatcgggaagaggaaactgcatgtaagaaaatgctcccactagattagccggtgagtaagcttgcgatgcattttcttgatgattgatatgtgtgggagggcccagtccattgtgggtgtgtgtggtaccaccccctggacaggttgtcctgggtgctataagaaagctgccaagcaagccatgaaggaggaacaagccagtaggcagcctctctccatggcttctgcttcacttctaagatgaaattagccctttcttccccaggttgcttttggtcatggcctttatcaagctataggaatcctaactaagacacccagcatggctgatgtcttaaccagaggaatggactgatctgagttcatgcagtagcctggtgattatcctttttcatttaaggttctcttacaatctgggtcctgcatctttaaaaaaagaaaaccacagaggtgagatagggctatcattcagtggaagggtgattgctagtaggtgtgaggccccaacactttgagaaaattaataaataaaactaaccaataaatctcaagagcggtatcctcttggtcaacagcaaatgccataactttcttatcactcgactgttagacacatagatgtggtttttgttttcctggtggtgtaatgagccttgggcatagagttgtacgtgtgtgtgtgtgtgtgtgtgtgtgtgtgtgtgtgtgtggtatctgtagaacattttccaaaagagaaaaagaaaagagtgaattctttttgagaagcattaggtgtcaagccttcgtacaaagggttaagtgcattgggaaattacaggtttgcatggtgctgtcaaatgaatatcacttatgtagaatgatacgtctagaattctaatcaaaaggagaataggttgaagaagcgcctgggtggggccagagtacagccccaagcagacctttagatctgtctgaggagggatctgctgtaaataaaaccccgtggagatggtgcttcctcagtcaactttctctagttgtttccttagctgtcgaatcgctggataggtttatatagcctaatatggctccagagctgagtgctgggtactcaccagtgggctaacccagtgctactgacatcatcgagatgtgacacagacctctgtgggaaacgagccagcaaatcagattctgaaacacgtgacattctttctctactaccacaagttcctgagttccagggaggggctctggagtgagaatcttacgtttccgggaattctcttaagggaaaagcccaggagagcaacagaggctggctttctatgcggacttgggggattatgtcaataaggcctctggctgcttgttgcctggctgttcccaaggagtgtattttgaagttactccattttgaatgtcatcagcagagctagattctcgtctgagggaatgttgggtgtggagaatctgctggggtcatttggcgccgagtcttggaagttagagcaaggttgcattaaagggaagggacaggattctgctggaccagcttgactcatgcaatgtcagggtcaggctccttcctgcctttccatatgtgcctggaggggcctggctggggcttcagtgaatgcttggcccaatgacagagttcattctaaaaaacgtctgtaacattttctttaaaagttccttcctgttttgcataatgtcctcttgcctttgacatcctgaaaccacagagctgctgttggtgtgacagaacaagcaagacagacttttttgtgtggaaaaaaagaaagactagacttctaagggagactcaaagaagctgacatttgtgttagacaagcatggcgacatggcctggagcctcttacattcaggtaaacactgtaaaaagcccgaggagaggccctgctgacaagcatacttagaaagaccccaaggaagaagacagacatggactcacttgcttatacagcaaatttttaatgagaatctattataatacgaagtgcacgaggtaggcacaaacaaggcccaggcctctgttacagaagagtcctttcaccatgggtgaatcttggccagccagatcctgaggccttgatgctcagaggcctaatgggcagagtgaaatgggtggtctggactagggccagcctcagaaaccaagggcccctaacacacactgattctggcaaccctgtctcagcctgtctgaacactctgtggtgttgtggtgggctggggtctattgctggaaatagcccatggtttcttctagttgctgtcatacagccaactgtccagctgttgcctccagttagccatagggtagagaggagaggaagtgcaggcggagggaagacagtgaaagagaggccctgctgcactgcaggctgcgctggaggcagcaggaggccaggggacctcagcgaggcaggaaggggagttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccacctgtaactctagctcctgggatctgatgctctcctgaccgctaagggtgcttgcagacacagtacactctcacacagacacacagactgaaaaaacaagtgaggaatgtccctgtcatactgggccgctgtgagatgtgagaaggttgttactgtctctgggcctcagtgttcttacatataaaatggggataataatagtatctacttaagagatgagaggtttagggagtggccatgaaatggcctaaaatactgcctaggacatgtgaagctctgattatattatcgtcaatagtagaagttctatatagtcccatgagaatacccgaggccacaaaaattgtactgaaacccatttgtccataacaagctttattttataaatcaagcatagtaaaagacaatagcagtaaaaatggagcaattttataattgttaccaatatgctataatgcaagttatttaagaacagtgaattgcttctggaattttccacgctgtattttcagacagtggatatgagtgggatgggatggtaactgaacaaggcagggatgactctgactctgacttctgatgaatttgcccccttgtcaggaaattgaactggggagccttgtatattctagacaagcattctacctctgagccacacccccagcccagcctcttgtgtgtgtatctgtgtgtgtctctgtatgtgtttgtgtgtctgtgtatgtctatgtgtgtgattgtgtgtgtgtgtctgtatgtgtatctgagtgtgtctttatgtgtctgtgagtgtgtgtgagtgtgtgtgtatttgtgtgtctgtatgtctttatgtgtgtttgtgtgtatctgtatgtgtctgtgagtgtgtgtgtctgtctttgtgtgactgtgtgtgtgtctgtatgtgtctgaaagtgtgtgtgtgtctctgtgtctctctgtatgtgtgtgtgtgattgtgtgtgtgtctgtgtgtgtatctgtatgtgtctgtgagtgtgtgtgtctgtgtgtgtgtctctgtgtgtctgtgtgtgtgattgtgtgtgtgtctgtatatgtgtgtgagtgtgtgtgtgagtgtgtctctgtgtctctgtatgtgtgtgtgtgtgattgtgtgtgtgtgtctctatgtgtatctgtatgtgtctgtgagtgtgtgtgtgtctgtgtgtgtgagtgtgcctctgtgtgtgtgtgtgattgtgtgtgtgtgtctgtatatgtgtgtgtgattgtgtgtgtgtgtctgtatgtgtctgtgagtgtgtgtctgtatgtgtctgtgagtgtgtgtgcttgcgtccatgtgtggagtctatcgatcagtgttctctctctgtcttcctcagtagtccccaccttagttttggagaagctcactcagtgcctgtagtgctcgctggcaggctggcaagctgtggggatccactgatttcattcttctcaaccctgagcttagacatgtgccaccatgcctggcttttatacgctgctgtggctctgaactccgatttccaagcttgcagaacaagcactttaccacaccgagttggcccagcccattaccttccaaagtgtaattttgcctataattaacctgattctttcattgtggctgcctagtatctttttagctttttaagattattttttaattaaatgtcatttatttatttatttattttttgaggcaggtttctctgtactcctggccgtcctggaacttacttgctctgtagaccaggctggccttgaactcagatccacccaccttgaatgccactaccatcaggcttaagttttttttaattacaaaattttacaatttaagaattttctcatatgatatactctggttttcattatgtagcttaggctgacctagaaattcgtaatcctcctgcctcagcctcatgcctgtttactaaccttactgctgaccccttagtgttcttcattccaggtttcactgtcataatcttgaacacattttgaattactttcttgggataacttcttggaaggaatctgtaggccagatatggtcatcttgatgacatgggttcaaactgccacattgctttctgagatgattggtgtcattcagagtctctaaatttgaaatccctggcttctgaagaatgtggagctaaagagaatgttgaacctatcttgagcctcatgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatattggattaaaaataagttgatgcagttgcttaaagtccgcagatataaagggctagtattttccttgcacctgccttttacttggcttactaccatcagagtatatcatatgagaatatgaattcagtagctgatgcgtgtcaggagagatcttttggggaaactaataaaacatgcctaattgcataaatggtaaagtgatttctaatgaccccaagtttatagatccaggagatgaggccactctcaaaagggacgctgtttttctcttctagcctctccctgtatcttctactaaatttgcagttcccttctgacttaatagggcactctgggttcattgaatcaggacagagttgattttacctatgtgaaatgggatcacatcttagagtgttgacaagaggactcagtggcacgaggcatataatcaaaactgttccttgggcacaggaagtgtgcactgagttccttaggctggcacagtaaagtcacttctaaatagagagatgtgaaactgtgaccaaagcttagggaagtggaaatcgcagagttgtcatctcctggccagtgtacagacctactccaggccatgagaagaagggcttcactttgtggaatccacactggagacatccctggaatgtgtgcttcccccatgtgttaggtgtgccaggtatttgtagctgtcaatgcagtcatctctaggtggacccagtttgtcagtattcagagcacaccagttgaatgttttgggaataagccagaagggagtgtgggatgtcttgtggagcggtgagaaggtgtgttgttataatttaaaattgggttggagagatggctcagcagtaaaagcacttgctcctcttgcagaggaccatggtttgattcccagcccccacatggtggttcagaaccatctggaaactacagatgcaggagatccgatgccctcttctaacttcttggggcaccaggtacacacacatagtgcacatgcgtacttacaggtaaaacattcatacacatcaaataaatcttagaaaataagaaaaaaattaaaatggagaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctctctctcgcgcgcgcgcgcgcacacacacacacacacacacacacacaccacatacacacacccacctccccacacacaccctaaaacaaatgttaaaaggtcaaaaaagagccgggcgtggtggcgcacgcctttaatcccagcacttgggaggcagaggcaggcggatttctgagttcgaggccagcctggtctacaaagtgagttccaggacagccaggactacacagagaaaccctgtctcaaaaacaccaaaaaaaaaaaaaaaaaaaaaggtcaaaaaagagtggtgaatccccctccattcccagtctggtgcttttgtcattgaaaggctgagggttttgacagtgcttgttaatcatgtggctttattcgttttgtttctgtttttacttttttgtttttcctttttggtccattctattgatgtagtgcacttttcatgtcgaatgacttttggccattaaggcaaccttgtatgcccaggataaatattacttggttattgtatttagtgtgcttattttttgcttgcttgagtttgatagtatgttgtcttagcttttttaattatgagagatttgtctgtagttttctttccttgtgacacctttgtctggttttgtatgaggataataatgcctcagaggacgaggcggagaatatccccacctcttgtggttttgaaagacttggtgtcagttcgtccaacccttttagcatctggtagacttctctggggaagccacctggacctgactttctgtttatatagaaagactcactcatcttttaattttatctctgccatctttagctacacaggcattctggtttgtcatctttcaactgtgactttaggttattttcagaatcgggaagggctccatcactcctgaattggctccccaacattttagtgcttgttactggtgttggatggagggcagaatggctgccaatgtgctgcggtttccttctgtcatatccattgggccctcggaagtaccagactctgccaatccaccccgttagccagtggatcaaagttcagctgtgaggttttatatttacgtcaacagaactgccttcccctataagttctgtcgttctagggagtctgggaagaaaggaaaattagcactgaatatctctaagtgccaggcactgtggtgaaagtctgtgtgtttataattatccccaccctttgggggaaattagagatagctgcatttataatggttctgatagcttagtattgcttggaatgcacagttggctgattgcccagatggcctattagactttctacagtctaatgtttggtcctaggaggagggtgagagtacacgtaagtagcattgtaggtcaggaaactgcatcagagtttcagaactgataaaaggactgactgatttagcagcacaactttccatacgtatatgccagaatgctaagttgctgttttaccggaagagcgggaagagtaaaactgacagcaagtgctttggagttctgtggctgtggctgagtgcacaactttgatcccagcacttgggaggtagaggcaggtggggatctctgtgagtttgaggccagcctggtctacagagcaagttcaagccctgtatagtacagggatacacagagaaacctgtctcaaaaaaaaaaaaatctgaagatgcaaacagccctacatagaaagtcagagtttactcagggaccagaagagtcaaaagccagagtagagaaagttcactcgggccactgtcttagagatcattgtgcaggcctggagtcttcctgcatcccagagccttacacatgataggtaagacagctggagaaggtgtgtgtgtgtgtgtgtgtgtgtgtgtgtgtgtgtgtgtgtgtttgtgagagacagacagacagacacagacacagacagacagacagacagacagagagatgtgtgtgtacatgtgtttggagaccaggtctctgctgtatggtcttggctggtctagaattcatgctcctcagttcccttgtcctgtcaccaccatgacgagctccttaggaagatttgtctgttgtgccaatactgcggtaaaaagaaaaccagaaatcatgtattatattcagcctttccatttgacacaatatctcagacttcctttgtattttgacggaaccttgctgaagactacaagccagttactttgtagaagtttcctcaggtttgctgttagttcatgactattctttttgtatattttgcttggccggggtctcactgtctagttcaggctagccttatacttgtgttcctcccgggctactccctcagcctaggcttatgcaactattccgtgattcctcccacttttctccactggatttgttttttaacatctgtaggtatttatttatccctgaatcagttactgtggtggatgatttctttgtatttgttacttaaaagatttcccccccccccatcaattctctctttttctctactctttgatttacagatcattgcagaatatgaattctttttaaaattatttttaattataatataattacatcaattatattataattaaagtataatttcaatgaaagggagaaacccttccctttcctgcctccaaactcaccccatgtgctcccctgctctctttcaattcatggtctttttttttttcattaactgtcattatatacatatgtatgtatgtgcacatatattcctaaacctgaccaacatgccagactgttgattcttggtttttactttattccgaagcttgccatcccaggtttaccgtgggattttctcccactggctcactcttgcatccttttgatatcgtctgtcattcttggagcaacttttttctggaaggagtgaggtattccaggaggctgctctttccttgactctgccctggcaccagccatttcagtgagccttagttctgttcaggagagaatatatgtggaaaactagaattagctgccagggatggattcactttggcttctagggtccatctctgttaccatgtgtgcgcttagcctgttgattctgactgcgcagagacactccgtacctactctgggttcccctgctgtcttttccttaatggcgaatatgcagactgcttctcacactgcttgcccagatgtcactgtgcagagcatccttgtacaagacactggggttagagatgtgtgctccagccccagctatgtgtggggtttgagaatttgaactgaaggcctcatgcttgtgcagtcaatgttttatccaccgagccatctccccagctaccatggggtttctagggggccttctctctggggttgacagctaagggcaggtacacgttatacaaatccgggctaaggggaaaaggaggttaaatctctgcttaggatggcaccaaatgaagtagaaattcattcttggaattcctccacaaagatgaacaccaaggtgactgactaatcgggctatagacattcttgaccttcaggcacagactcttgatcttagagcctagggtctctgttttcaacgccggtggaaacctttttacctttggacagaagtaactgtccgtttactccagttctggaatctccaagacgtttccctgcactgtcttgctcctactaccgccactgaattcaagagccaaaaccaacagttacacccgagaagagtttagctcagtaaaatcaagtaagacccaactttcttgctgcctccctcagtttactccctggaacctgagactgagaaagattcgagacagagatggggcatagcatggggacagcagaggcagactgttaggattgcctctcctccatgttgctgtctcatgactatcagatccccaaatgtttattaaaggcaagaagggcagctcttcagatccaagagtgctcctgagctactgtgtcagcccctcttgttctaactcccttcacacagaggaatcatggtatctcctctggccctgggcagaagtctttagggtctgacttgaggtgggttctgacccttcaaggtaacataacctggtcataactttgtttctttacttagatttctaagttttaatgcatttaatgacagtttcatggattgactggccaaagctgaggtctttctggtcatccgatggcctgaatcagactttgagacttggagattgggctcattctcacaggaaggggtagcatagggtgaagagcctggtttgtaaggtagtgtgagcctcgatgaagaaaggcagtgcatctctttaggttagtctatcctttgccacaaactcaagttgtaagtaagcctgtagcctggagaaaatttaaatgtaaaatttaaacttattttgagcagtatcagcagcctggcaacaaagggcttgctgaggcatagagaaatgagtggctttgcgatacgaaaccctgtctcaaagcaaaactaaatccaatcaaccagtcaggcaaacaaaaccaaccctagcactcatatcaagatgcagtttcctggggctggagagatggctcagtggctcacattagctgctcctcttctagaggacctgagttcaattcccagcaaacacatggggactcataactgtgtatgatgccagttccagggggatccagtgtcccttttagggtctctgggggcactagatatacatggggtacacatacatgaaaataaaacactcatacacatacaatgaaagaaacttaagataaaaatcaaagatgtggctttctgggctcctcagaatgtgtaggtgagcagacacacttcgcagctgactctcccttcacttgagtgtgataggtggctttctctctctagcattttgaaagccaaccacagtgcttgaaggttggggagctcttcaatgatgtgcacagccatgtgtcaccgtgtgagaaatggcgggtccatgaacttggtggctcactgttggtgaagctactttctgcacatggaaggttacaaagtggggctctgtgggcatgtgacaaggctgtcccaagcggagagatggacagaggagaaacagtctccaaagtgatgcagctttctgcttgaccttctggccttgccttgtcgagattggtctgacaggttcctttattattatttttttttattttgatcaaatactttttttttttttttggtctctaagtgtagagttcttaaaccacagatgtgttctgtttcctgttgaagatgggctccccacccactccggctccaacagtggatgctgagatggcagaacaaacagtggctgtggagcttgtgttctctgcatgtgcccgagatgctatgcagggaaagagaatggtttccatagcccggtcctatggtttgaacaggaggcgttggacacacctagagtcccagcacttaagagggagactcagactcaggttcagtgcagggtcactcagcatcacagtgagtttgaatcttgcctgggctgtctgagagtctgtctcaaaagtaaaacaaaaactatatgatctgattcttgcttttttttttttttttttttgcatttttgtgtgtctttgagtgtgtgttccatggcacacttgtggacaccctatggaaggtggttctcccctcccccattgggcctgcatcatgaggcaacaagaaactttacctgtcgggccatcttgccagcccttatgtgaaatcttcatattggaagatttgttttttctttggaactgaaagccgggatcacttttcctggattataatggaaatgatttttgggttttttgtggtttttttttttaagatttatttattatatgtcagtacactgtagctgtcttcagacactccagaagagagcatcagatctcattacaaatggctgtgagccaccatgtggttgctgggatttgaactcaggaccttcggaagagcagtcagtgctcttaaccgctgagccatctctccagccccctgaaatgattttttagttcagctttaaagacgtgcttcaaaggtacaataaaatgacacaaaggtatgatttaagaagtacattttggctgggcggtggtggtacacgcctttaatcccagcacttgggaggcagaggcaggcggatttctgagttcgaggccagcctggtctacagagtgagttccaggacagccagggctatacagagaaaccctgtcttgaaaaccaaaaaaaaaaaaaaaaaagtaaattttgctgggtgtagaggtacactttcaatcccagcgtcccgtagaggcaggcagatctctgggagttccaggtcagccaggactgcagaatgagaccctgtctctaaaggggacgaaaaagataaagcatttacagtgcctttgaaatctttgtgagtttacatttttttaattaaaaatttaaaatgacattctatttctctggcgtgtgtgttgtgggagaacatgccatgcttgcgcgtggaagtcacaactccaagttcaaattcactgagccatctcactagcccaggtcttaaaaaacaaacaacaaactagcatgtagcacgtttcctaacttatgtgacgtgtgcttgtgtgtatgtgtagcacaggtgtaatggtcaggggacaccgtggaggagtcagtttactcctttcaccatgtgggctctggggatcacgccaaggtgtttaggtatgctagtgagcacctcaccctctgtgccctctgtcacattggccctgagttagattttaaaactcagtaagaaatgcttcgagggttggagagatggctcagcggttaagagcaccgactgctcttcctagaggtcctgagttcaattcccagcaaccacatggtggctgacaaccatccctagtgagatctgatgccctcttctggggtgtctgaagacagctacagtgtacttagatataataataaataaataaataaataaataaataaataaataaatctgtgggtcgtgtgagcggggccggagagagaaaaaaaaaaaaacaagaaaagaaatgcattcacatgggaattgagagtccattctgatgttcaccccatgtgtatcaagtcttcacttggagtttactgatgcaagtttactgtgtttgtcagtagcagagcagcaccaactgtgtgcagggccagttgggtaagggttttgtttctggttttgagtgttttgttttgttttgttttttgtttgttttggggttttgttggtggtggtttgttggttggttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacacacacccaaacacacacacaaacactcagagtttgtggaacagtccctcactgggggaagaggtcataagagggcctagaccatgagatctgagacctggccccagaagacaaagacagaatctcggctcttagggtgattgcctcctagcaatcctgtatgcctactcctatatattcctcaaatggtggagattcttgctcagaaaaaatttcagaagaaatttagggacctgacccttgaatatcaaaaaggatattttaaaagtaaaattaaaaaaaaaaaatcaacccactgtcaaaatccagcatggtttcttattttcttagtggtaggaggagacatttgaacacattgggaagcactcagtcgtggaagaaaggaaggctctgctagtgcttgtgttcgcttgaaagacatggtttcagcatttcttagtctggtgaactgttttttcacaactgaacctcgggctaaggattatttatttcctgaaccactcactgactgccccgtcagtcaggagtcagtgaactggatgttccagtctgttttgctgaggctagaaaactgaaccagtacccagccaacttgcaagtgaggttcgagcctgtattagggttggcttagattagccctgttttaaaagaaaataaaggcagagttcacaggtgggttcactgatctcacaggtggaggtctgtgaagtcacacatccaggctaaagcaagggggttttaaagagcttaggcgaggagcaatgatgtgctagccaggagctggggcggtatacatacacagtcggaatctgagcccctgggtgtgcactcttgggtgggttgccggaaatgcgaacgagcgatgttagcctggagctttctccaagagggtggggcagatggggtttctcagtttgtgcaggagctgagcagggcttccagcctaacagtcagtattgttgttttgttttttttcaagacagggtttctctgtgtagccctggctgtcctggaactcactctgtagaccaggctggcctcgaactcagagagatccacctgcctctgcctcacgagtgctgggattaaatgtgtagccaccatgcccggcttagttctgctttccatacatacgtgggcctatgtgtgtttggctttggtgtatctttctttttttattttttaagatttatttattatctatatatgagtacactgtagctgtacagatggttatgagtcatcatgtggttgctgggaattgaactcaggacctctgcttgctccagccctgctcactctggtccatttatttatttattgttatatgtaagtacactgtagctctctttagacacatcagaagagggcatcagatctcattacatatggttgtgaaccaccatgtggttgctgggatttgaactcaggacctttggaagagcagtcagtgcttttatctgctgagccatctcaccagcccctggtttatctttcaaggaagcagtggaatttacagagttgaactcacacattgaagttattgagcaacttacacaagaggccatgacctgaactcccagccgtgaggtccacgtggcagtgcttgggcctggggagctgaggacagctcccatctgtgcttgtgtaaccctgcttcccagctttcagagccaagaaaacacacaagccagcccagcggggctgagagcctgcagaagcacacgcacgcacagcgagagtgcctcggcccagctgaggattatcatcaagtactcaggccttcgctgtctttcgtccctcttcctgtgttcatgggcagttctgagaactggtagccaagacccctgtttgtgaatggtatcagtccttgcctgcctggaatcttggaactttcctttttttttttttctcatcctttttttgtttgtttgtttttgttttgttttgttttgttttgtttttttgagacagggtttctctgtatagcctggctgtcctggaactcactttgtagaccaggctggactcgaactcagaaatccgcctgcctctgcctcccaagtgctgggattaaaggcatgcgccaccatgccctgctttatcatcctatttttaatgacagttcttaaatgcttcaaccttctttgtaacccaccacccaccagaggttgtggaaaagaaaggatccgggaagtggacctgtttagaaaggttctttggagcaactcccgtctgtgttgtctagaaatcagcagttgagttcccagtttagcaggcagcggcagctcgatcctctcgcaaacacttcatagataaaccagcagtccagtttggtagagctgggttagcaacagcagtgacacaacctagcagagacagccaggcctcagcctcagcttgagtcagcaggagggaccaacagaaacaccaggagaagttcttagctgtgcctctctcagagacgtgagacccacaagcattgcacagctagctgtaccagcaagccaagctctgtctccgacactcagtgaagtcctatctataccctccacacatcacgtatgtcctctgtgcctcgcctcagcatgtgcatccaatcagcccaagtccttggaagcagcaacaaactgctgtacactgccagaagttttttggtgcgtttctctctatgacatcccaaagaatctttcatcacgtgccctttcacaggcttgctttagcagaacgtcctctcctgtgcctgcttcagcggaaacattccttcacgtgtttgccccagcataacaccatccaaccgactttctaaggaacccttgagtgtccacctcagagtctagttccttggatttttctcactgcggtatagctgggtatgtagtggaggctagcccctacagtatggcagcaggtctgcggcttcctggccgacactggagccgaggaggcattcgcctatgggcctgctgctgctgtgccctcttcactggagaggcgtgagctgcataatttctggaatggggtgtcagaggtgggggtgggaaagaactgccccagggaaaagagtgtggggtgaggtactcgccatgtattgggggcatgatgaggtgagagagcggtgcagaggggagcaggggcgtgagaaaggctgatcaatggccaagctctgtggagccattgaaagagcaccatccttgggcaactggcgaccagggtgttttccttttagatttactacatatccatagaaggaacttccgggaggtgagaacattcgtgattcggctcttctccagttccctcaactcacccttctttagctggcatacaaattggcactcagttgatacccagaaaacactgacacgaacgctcttgacttatcaatcacaaggagcgtttgaatgaagcaaatgtttcagaataaaggctggttctgctcttggtagggtcccagggacttggtcagcattattgataccatgtgtgtgtgtgtgtgtgtgtgttgtgagtgtgtgtccaggaatgcatgtcacatgcatgtattcatgtgacagaggcagacagaaacacagagagagagagagagagagtattggagttgagtaggaagaggtgggagtggaagctaggactgcccatgtcttcttcctggctggttagacagcagtgttgctgccaagggatcgctggagggcaaataagttagacagtaagtgccgaagggtatcctgaatagttgttacttggggtaggttaattcaggtgtctgtggcacctaggtagctagcagaaaggtagggaatgaaaacaggatttggagagtggtggttcacctgggtgaaagggacaatgattgttaccaaggaaagaggctgagaaagcataggtgacaagtaggaggggatatgagcgggcatggtgctgcgtagttaaggtttatttcttgcccttatacccatcttggacattcatttcttcctttctgcttggccattcatgccatcttgggagcaggaaagatggaattaggattttcagaagatcctagtttggggtttgtttttcctggttttaaccagtactctgagcctgtcaggtctagacttcatctggtccaatatatgtagcttatgaatggagtagatggaaattgttcaaggatcatctagtgagtcactgatgcggctgcactagggtgcaggctcctctctcctattcggggctctttacctccgcatccttccgcaagggcagcccaggacacttttcgccctgcaggtgtatacttgtggaagcttggcagaccacatgggaacccctgttttctgggttggtttcagaaggtaaaagcacctggtaggaaggcaatccggatgcctcttgggatcttgtaagtagggtttatgttttacacctctacagatggcgtggggcctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctctctagggaccttcattgtttgaaagtttcaaggcttgtgaaaacgaaccaccaagttctctattgcccagttcatcagtaagagttatttggggtctggagagacaactccatcagtaaagtgcctcccttacaaatacaaggacttgactgcagatccctagctcctaggcttggcagcattcatctgaagctccagtgctggggcagggagcagaaacagagacaagcagatccccggagctcagcctggctaagtccttgagctccaggttcagtgagaaacctcgtctcagaaatgacagtggaaagcagtcgagaggaaaaaaaccagtgttaacctctgggttcagacccacacccctgtacacacacataggaacacacacatacacagcacatggacacattaaatccagcatctcttgagctttttgttaacgtctctcccaagagcagctgagttggactgagactgggccagtgtcctcaggagatcctcttgatagggttgagatctgctgtaccaggtgactactaacacggtcctcagagtccctgatcaccttagggcatcttgggaggtaagagctgaaacaatagccgtattgttaagaagtagttctgcaagactcatgacctccaaaagggaggtcacaatctggattcaggacacagcccttttgagttagaggctgtgtccttccttgcctaagctctgtgtttctccagaaagtcaaaggatgaaggcctgcctgtcaacgcaaaagttagttggttcaaggaagtggggacggctaaggaaataggcaaccaaaccagggaagatggcttgaacggtgtgggcctgttcaaggcccttggcctccttttgtgccaggtcacagagctttcaccacgaaggagagttgatcagaactgtgtctcagaagagaatgaactaatgggaacaggtcctgtggtgaaggagcagggacataagattgagaaggatcccaggaacgggagagaaggtggcagctgtcaagaaatgcttacagacaggggacaggctcatggcttcctttgcaagaggtagattttagggaggcagctcctccctgggcatgtgaggagctcctcctcctcctcctcttcttcctcttcctttttaataaaaaggacagattggaacctgcagaggggtggacagaagtgagtgtttgtccttcgtgtatttcaggtgactgatctgtcccaccttctgtggcttcctccctgtgttctagtgcctggtttgtttgacatgtaaagctggccaccgcagaataacagttccccaaatgacaacatcagttcagcgatgatatagttaggcagtggtgaggtagagaactttgaggggcttcttggccgcacagttttttcagtgcccttgtgtgcgttccagaagcaggatttaatctgcgcggctcccatcctgacttgtcctgagcatagtttttctacggagcatcttgctgggactcatgtttctggaacctatattgaagatgtccagggagcatagagtattgtgagcctgggcttgcaatcttgggtctctgcctggaccactttgtgcattccacagggtcttttcttccctctgtccctgaccatgtcagaatctgctgtccctgagtcttttgagccaaccactttcttactgacccatttctctgacttcttcttcctggacaggaactctggagccatcctagcctcaattcataccgatactttattggccactatttctaagctttttttttcttctttagatctttctagcttgttctttttgtgtcccctccttttcctctgggatcttatgaccgccagccttctcttttgagtcccttttattcccccccccccctgctgtcttcattttgaatctgatttcctctacggtgattcgcccacaccacacctgctccttccctttccccagttagatcaggtttagaaagagccgtggtagtcgtatgtctaaaaccacactgatggcaggtggcagagctcgggattttctgagaaagtgttttctcatctgtgctcaccggtctgtaccgcagtaccccagctctgggagtttcctgaagtgactgatcacactagggctgggcatgaatgccttttctacatcaccctgtgtcacccttcttccaggaggaactgtcccctctgtagctgtggtctggtcagctaatgcagtctgcggcagagaggccctgtggctggctaacttcttccttccccctctctagttggccccatgctgattgactttaatattgctgtggatctggagcttttggcaaagaagaacccagagataaagacgggcggccgttactcccccaaggactgtgtctctcctcacaaggtggccatcatcatcccattccgtaaccggcaggagcatctcaaatactggctgtattatttgcatcccatccttcagcgccagcaactcgactatggcatctacgtcatcaatcaggtgaggtttgggaagtgggacaagggaggtagaacgcaggcacacaagtgtgtgctcagtgagcgccgagggaagggagtgatctcggtctacaaggatgtgtcaactctgtcactgttgctgtcctttaaacagtgcagcgagctaagtgccaagcggtatgctcgcttgttgatatagctctgttagccaagagaaatagatacggtgtgcttggccttttaaaagtaaacttccagcaaaaatgaaagaaaaagatatctccaatgatcgcaaagtaaaacactgattatttaccatttttaggctactctagctttcttcctactcctcctcctcttctgctgctactactactactactactactaataataataataataataataattccaaaacaatccatttttgtttcagattttttttggcaactttgaaatttatccagctgggtggtcagtatcattcttcagggaccatccataagagaccatgtatgtctctacagccagccatgggtgagaagtctgggggagtcctattctagagcctcagagagtgatatggactaggctgagtttcctgctgtacctcagattgtgtgtgtcaggctctcatctgcttaggatacaagctgaaaacttagccagcctctatcaccacaacccagattcaaatagatctaaagcgttttaaaggttcttttgaggcagggtctcactgtgtagccctggctgtcctggagctcactttgtagactgggctggctcagtctcaccgagctctgcacctgcctctgcctcctgagtgctgggattaaaggtgtgcacctctgccacctggctcacaggctattttaaattgtaaacaaactgctttgtagcaaagtcttcatctacctagtgtgggctggaagcttcaaggtggcggcatcttacacttctttaaacatccctgtagcaactgaggcagccctcagatatcctagcttccctaatgcaacataaagccccctgactttgatagaagcaaaaaaaaagggggggctcaaaatgtatgttgaagtaaaggggcagtctttccaaaaacacattttaatgaaacttggcacctaggcaggtaagtcagactcatcaacacacctagattacagaatatacatgaatttcagtattggggacaaacttgaaaaaccaaagttatattcatggggaaaacagttgtgctcattaagcatactgaagaaaagtaatgtttttcgttttttacttaatttctttaatatttttaagttcttggtgcatgcctttaatcccaggactctggaggcagaggcaagtgcagagaatttgaggccagcctggtctacagatcgagttccaggacagccggtactacacagtgaaaccctgtctcaaaaaacaaacaaaatggtgtgattggatggatggtgactgtttaatgcttttgaagctcagaggaaggagagaaggctgtgccccgatatatctagtacaggagttcctaaatgtgtgaggaaggcagatctcactgttctagaatcttccatgtactgacaccttgtgacctccggaagtgtttccttagctagtctagacagctattttccaagaatcatctccagtgatgagtgtcctgtgagtcacgttttggagaaaacaaccctaaattacccgccgtctgcttcctccttactttccctgagataggaactccccgttctctttctcccccacttgtaccttagtatcagaaaaggactcttttttaggagctgggggtgtcactcagtggtagaatgcttgcctagcatccacgggtccttagctttgagtgtcagccttgaagcaaagaggagaaacagtgtactaccctgtcactgttctctagagcttgcctagaccccagagggcagggataaaaaaaattctgctctgagtcagggacaagtagagagaagaactggtcacatgaataacgctgggttgcaactaagccccaggtaagattcctaagttcaataatgtcctcccactgggccacaacagctcttcttgaggccatgtatcctcttcctggcatgtttctcaaagcctggtatccagggctgtaagtgagccccataacctggagagccacttcccagtctgtgatcatgggcaggccacagaagcccttgactacttaataaacactagctgttatttctttcctgtccttcttgcctgttgcctctgcctgggaccttgctggtaaattccttattgttcttccagcctcctgctttagcccaatgaagcaccaatatcagggtcttgcctcccacctgttagggcctctatggggtcagaagataatgagtagccggtgtgagtcagaagacaggctctcaagaagactcaggggtcatgcctcataaacttttttaggaggaaggttgtgtcctaagtccactgggtttctatggtttatacttgctgttaaccttgttcagtgtaggcccctccagccactatgaaacttaaagctcagcatgagtgttctggaggggagtgtgggaggtgctcccccattgttgcagagaggggcaagggtgtcctttggggttctgtctctcctcttgccatatgtatgcaggtcttgctagagtctcagcatatcctacttggtgtcatgggtcctactctgacacttaggtatcaggctaaattcagccctggggtagaccttggtatggaaatgaatgtcagggcgtcatataacaaacagggagtgtgttctgtcactcacacttcagtcaggaaagccaggtaatagtcaggctgccacctggtagcaccagccttaaatgaaaaagacaaaggaagaaagaaaagcagaggtaaggagctttagaaagtatccatcataaaaattacagtcggtcatagccactgcagtgctttgcccccgagtcagcagctgagaggcaactttcccagtgtcacagtgcttctgtcacctttgggtcctcatctttctgactctgtccgtgtcacgtctttaccttaaagccttcaacaacttccccctgccataggcaaggacctgagtgatctgaaaccttatcgtgggatgccacctggggaatagtcctgacctacttccagccacttctccttgtcacccttcacacagcttgctacaggcaagcagcctgtcattctcacccagacacttgtcacctcccccttgtactctgtgcataggccttctccggtggctttttctggatatgatttaagccttgacctcatgagctctgtgaagcccctgaagtagaggtgacctctcctccttctcttggtacaagggacaattaccatttttgtgtctcattttggcccttgatccttagttcctagccagactcacttccacatgtctgaccgtggatctcctccgcagtccagaatggactctgcagggtttggaacatggggtttctttctttgagtcctgctcatttattgatacccatactcaggacccctctgcccccggttctctagttgggcccattcctgctggaagcaaagcctcctctcctagcttggccatattatgacccttttaaaactggcacagtccctccccagggcccttcacctgacgttcctgtgcgttgctgactagggtataggctgcctgtgataaaaccttagggcagtcttcctttttggggaagatataatatgctttagccccatgttggctcataatcataaaactcttttgagtcaagacatgataggtgattcaacccgctaattgtagtccaaaaagaggaagattgcaagtttgagactagcctcactacatagtgtgctcggggctagcctgggctagcaagccccaaacccaaagcacagtctctcgtgttcctttgtattttgacttgcatagacctctagtgagggctgctttgtaggctgcgtaggcaatcagatcatggtcactggcggactgggattaggtgatgatagaatgtcctgatcgccatgatgtgtacttggtgtaccatgaggcttgttagctcatgtgagagaggcagcagcttgttagtaatagctgccaagcccccaggagcctttgtgactcgtgatacctccaggcagacctggctggacaggctttgggaaagagagagtgccagcctgtgctaggaggtcagatggtgctttgtttggctgtgactttgttctgtttttgttttgaagatactttttgaaaaacgtgtgtgtgtgtgtgtgtgtgtgtgtgtgtgtgtgtgtgtacacttgtgtatacatgaatgtaggtgccagtagaggctagaagagggcatccactggagcttgagttatgatgggcaattgttggcctcctaatgtgagtactgggaaccaaactcagagagatgctctacaaatgcaacatgtgttccccaccactgagccgtctccagcccctcctccgaggaccattttaggctctaagatagcagttcctccaggaggtcaggatcagttatggcaaagcagagccgtgaaggtggctgcttcttggcccttaggacttgacttctgtcttgattatctttatgtcacctgtcttctatttcctcttccagctgtcaatggatgtgtagggggatggaactttaggagggagagggctcagcggttgaccttcccttgccttggggcatgactgatacgggggtggagtgggagtggtggaagtgtctgccagtccagtctgagtgccaccctctgccctgctgtctccctgtctgaccacatctgtggtttctcctggggagtgtcgtagcacttactggtactcaagcgctaatgaataacctccagacatttacacaaaaaagggagtgacagtgtatttggacttggctttattggaagagtggtccagtgagtcctgccgcagcctgaggcttgccggtccctttgcccatatcttctgcgtgtgccttcttttcccttctagtggggacttttgcctctacttgtcagtcctgtttgtagcaaagcaaactgaaggaggagcgccttcctattcatgagtggcttcttacttttcacctaccttctcttctgtcctctctgcctcctctaaagaaagaaaagtcgacttacctaccgctgctatcctaactactgccgtcaccttcgccgccaccgctgctgccactgccactctggtaatgtcctcacatctgacacagtgccaggcctctctggcagggggaagctgtgaataagcccctgtgactgtcttccagctgtggtgcctcccaggcaagcacagggctgctgtggccttgctgggaaaacatcgagatcagtggaagccagctcatgatgatgcagaacccgagagacttcgccggctttagattaaaccccggtagagctcacactcatagtgtatgtatataaatgtttatatcttgtctttctcctcaggtcatatcattagcatcttcccatgctgtttcatagtctccatatccataacttcaatgctttcatagtaattggtcactgagttctaccacaattaatccttttctttattagaagcctaaataaacagtagcaaacatcctcaaggctcaggtttgctgtgttggcttcttctgcattcaagattgtttcctcaggctagattttcacacataggattgttatgttaagaaatacgttgcacatctttataattaaccagtatgtagacaaattgctttttgaaagagaagtctctgtttttagcttgtgtcttacatgctgctctcccagcctgtgttctcagaagtaaatgtgctcacccttgtgactactgtagctaacagaattgcctcccaagagtatgggcccttgttctgaagagcctgtgtcttttacttagtggcgaaaaacttaaaagtcccagattcaagttctgttggggactgtgtctaagcccaaagccaccaacttattatgcataaaaactagaacccagctgctaggaactgaaagaagagtagatattaacctgccacggattctgcatcatcccagctcctgacctcagctctgagcgctcgctcctagctgtctcacaactcactcagccgaggtcttagcatcttcggaggcacagaaagatacttggggcatggtcagcaactgcaattggctacagacctgcccctggatttgaaggtactgtgagtaggagtggctttttgatgagggtacgacaacctaatctctcccatcacagatattctgattcatagagaatcctgggagcaaccttgttgttgagctgcctattgctggtgtgtcctcaggccatctgggtctcaggatctgtctgctgatgacagtgtaggcctgcgtccctggaaggcagaatggttggacagaggctgttgagacttggacagggtgaaacatgactttctttagctggtcctctggccttggttgcaatcaaaggaagccacttttgtccttcttagcttctcagactcagggtttccctggagactagacgagactctgggacctgttctgtccccctcacccaaaaggctctcatgaggacacatgcttagggccaggtgggcatgaggaactctggcttgaattcttcctttaaggaggaattaaaattttacccaccattccttcctaggcttgcctgttttatatgaactgttttatacaaccgtttttctaattgaactggtctccctgtcttttcctagactgagagacaaatccctctagacatgcaaaacagagtgtaagactccctttggcctagagggcccacctctacagctgtgttgaattcttgtttctaaagtgtttctttttcctcatcgtttttttacagatctcttcccacatgatgcctcctccccagcccagtgtctcttctctcatctgcattctcagtcatttagaggttttagcaatttgggggcttttcttctttctgcctgtttttccccctcaaatgaggaaaggctaactctaaatcttgtctgccagtgtgcaatgtgagaaggccacttttaaaacctggatcatgctggccaaggcggtacatgccttcactcccaatagtcagtctctgatttttgaggccagcctagtgtacacagtgagatcttgtctcaataccaaagcagacagaaccccaaaccgacccaaaccaaagtaaaaaaaaagaacaaaaaagctgagtcgtgtttttacagaggaatgtgcctcagtgtgaagtgtctcctccccagacttcgcactgggcattcccaccctctacctcgctctcgaaaggtctcaggtctcgcactttcttctgcagctggaggcttaatcatgtgagtcacaggctaattcccttaagcctaatcctgtttagaaatgccctgtctgtcagagcagcaggaattgagggggactcttgaagctggtaaaaaagaccacaagcaaatgctaaagaaggtggagtcgcccggagcgtcaggaaacgtggccacaggactctagcctgatagtctgatagccccagatggacgaaaagtctgcataatcatggtagtagctgaattgttactaggtagggtacaaaggccttttgtgcactcttgtgacaaagcaggaaactgaggccagaagaataatcatccattcacttatctagtaagtggagaaactgggatgaaagtatctgttttgtctcagttgtgtatttggcctggtctggcactaggtgcttgataaatttgcacttaattgagtgaagcagtaggtcgtgatggtgggaaggagtcgtgggaggagggtgacttctgtctctaaggaggttgagaacatcttagaaaaacataattggctttgcatgctgtctttctggccaagaaaggaaagcatttcacccaaagaaaccagaaaataatttcactttctacagtctcaaggagagaagaggaaggtacattttgtctgtcttcccatttcaagttcctgcagggcctcagcacatccgggagctgataccacatactttcctccttcctggttcatgtagatggcactacttagagaagaggcctaggagcgagcatgttgttcaggttacttgggaaattgtctgactagttctgaatgtggtccagacagccagagtcctctctgaattgaaggaactgtgtacttattctgtttatgggctgtgcgcccccctccccaagtgcatgttcatggttccaaatttcaagctcctggaaagtgaacactgcataatcttgagcaatgcttagatcaaacagacattgccagcaggtcctgtggagtacagannnnnnnnnnnnnnnnnnnntccagatcttgggcgtatgctaagagaaagggcatagttgtacgtttggagatacccttaggatatcccgtaggggttagagtctttgggaattcgtccctttcacttattagaacagtggtcattggggctttgtgttccaaagtgtaatttgggttgggacaagactattaaatactgtcaagatgttcaagccatataccacaagggtagaagcgcttactctgtgccatgtgtatgacatctcccagtggacattaacagtacgttgttacaataacagtggttctaataacttcttagttttcctattcacttcctactcagtggactttctgccccgtgccttatgtggaattagttgaactcagaacttcagatgaactccttgtggtggagcagccaaagaacacagtgttctttgtgttctgcgtggttgaaggactttgatagagttggagaaaggagctcctgtgtgctaggtggtttcttaatttattcattgttttctaacttcctggtacctccctttttctaagtagtttgtttgttatctacctgatggacagacagcccgttgagtgccacgattttcaagtttccatccaggcacagtgagagaggagttctcacccatgggctacaggcccttgtaggacagtgataactcagagtggaggttccagtcccttgatcgctaagagtttccgggaaaaacagctttggtaagtgaggattccacagtgtggggccttcactgcttcacggcactataggaggtcagaatgtgaaagcacatgttcaaaaagaaatttgtgacctgctaggggtaaaggacagcaggcctgtgttgggaccatctctgctaacaatgggacacaggagccagtaagaaccaacaccccagagtgatcctcaaggagctgctttggtcagaactttacagaaagtgtcaccatctaccattgtacattgttacttgttcatcagattatctgtttgtccatccattcatccatccaatccatccatcaagctagacagccactattacacttttatttgatgacagtgaggcactagttgactaaaaatcaaaagtgtaaataaagcctttgtgacacattttcatgggtgatactaagaacaaacaaggtaagtcattaaaacacaaaacaatctttccaccatcaggcttggcaacttgggcccatcagctggacctagtaagcacaggtgccttgtctctaaatctatcatgtgtatctgactgcttcctgctatacactgtgagcattataagggcaagaattaagtaaggttcaccacattcctccagcatctaattgatggtctgatagacatgtagaattccaacagtatgtcagtcagactggaacaaattggaggtgaagaggcacccaattttcactacttctatgtattgttgctggtgtctataataagtgacgtgtgtttaaatgcctttcaccttttcttaagagctatatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacagtctcactatattccaaactgctctgtattttggctggtctcagactcataatctacatactttgggctcgttggtgccagattacaggtgccaccatacctggccattatctatctatctatctatctacctatgtatctgtctatcacaaatctatttcattatgtgacacacatgacttgtttggccatttccccagtgatgcttctgcaactgtttacaacctgctcctatgatgcatgcttcacagggaacagtatggtattgttcacagtttgtcacacacatgtcagcccttctgttgggcagactcctggaaatgaggttgctgattcagggggttgacactcaggattgattgtgaagtaagggcagaaaaatggagcccaacagttaactgttagttaaatggccatgtgtcacagacccagtccttgtgagtgatctgctcaaaggtcacgtggcccctaatagcacttcttgtttctgcaccaggctggagacaccatgttcaatcgagctaagctgctcaatattggctttcaagaggccttgaaggactatgattacaactgctttgtgttcagtgatgtggacctcattccgatggacgaccgtaatgcctacaggtgtttttcgcagccacggcacatttctgttgcaatggacaagttcgggtttaggtaagacatacttagccagagtctgctgcaaatgtggtaggttctccggtgtgaactaaaaaatgtagttcctctgtagtgccctcgactctgcaggagaccaccacttctgagaaatagttgctttttttttttaagtgtatagtcctttcttgctggagaaatagtccagcagttcctaataattactgtgtatcctgataacagttcttaggtttgggcttccaacagtggctgcatctcctcactttctatccccctctgccccacatagtttgagaagcacagatactagagattggataactccacagatgtccttcagcactttcaaagagacatggttctttttctaagaaaaacatgtgttcctgctcaaacatggggctctaacttttgtatcacagtgctagtgaagagacagggtagcagtgtgatccaaaccttcctgacatgtgtagaagatagtcttatcgtcagttgtctaaccttaaaagtcaaaggcccaggcacagtggtgtacatctttaatcccagcactctagaggcagaggcaggtaggtctctacagtttgaggccagcctggctgtatactgagttccaggacagtcagagctttgtaataaaactgtcttaaaaaaaaaaataaataaaaagataaagtcattaagtaaataaatgtgcattttacctcacagcccatccttgttcgcattaaaggattattcatttgaaaagcattatctttcccttccttaagtaaacctgacatttcaggaagctctgccgcagctccttgagtttaggctgggtgcaagtatacttggcctgtgcaaatagcctgtgtgtgaacacaactgctctgtcagactccggtgttctcagctcccttgatcggggcacaagagctataggacaacgtagaacctaggtctccccatggtcagctgttcaggacctacccagagtggcccattaggactcaccaggagctcgtctgcacccgcttgtcttccctctgcttgagtgtcttccctttgacaggtttgtactctggccttcctcattcttctcttgaagagtgacgaggaggcctaagtaacctctgcgtgcttcaccatgacgccagcaatggtttacagacaccctgtgatggctggtagatagatagagcaggtagataagaaaaggaacagagacagcaaaaatgctgtacctactcaagatagcacacacttccactgaagtaggaatctatttctagagaaccactgactcacaagacctattattagtccagcaacctttggttttaaccaacattaaaagtggatatataggagctggagctatggcccagtggtagaacagtttcctagcatgcttgaggtcatgggttcagtccccagttatgcatttgatacacaaccccccccccaaaaaaacaaacaaacaaacaacaaaaaaacggtgtgtgaggtgtgccagaaatgggtaatttgatcctttatggtaccatccaaatctgaatccattgttcattcaagcaaaactcctgggtctttccttccaaaccctgaggagctctgtccttgtaattgtagcaactgggaggcaggggtcgggaggatcatttgttcaaaggtagcctaggtgagtgagcttgagactgtgtgtgtggggggggggggtacacatgtgtcttgggggaggcaggactgagttccaggcattgtggtgtgtaactgtaatcttagcacttgagaggccttacagtaaggcgggacaattgtgagttcaaagctagccttgatacaaagcgagagctttactccacacacaacttcctctccaaaaagaagggaaacactcctgatatttcatctcatgtgctcggttgtgtatgtgcagcttggctggcattttccttagttcatggaaagaagcaaaccaagattttaaacattaactttagagttgagtgtggttgggagttccacttagggtaacagggtacggaagccttgagagggcctgcccatggacagacctttgtgtggcctttggagcagaatctgttcttcctaaccatgaacgtttcaagataaagagggtggagaaagacaaaaggccccagtgtccccgtacttggaaatgtggaaaagtaggtttatcacttggctaagtcagaataactgactgaggcagtttgcagagatacagctgccatgttaggttggtgttcaaacctttgccttggggagaaagaaagactggtagagaatatgggcaaggacgagcggtatgaggtgggcagggccgcctgcataaggaccttttttggcaggaacaaggtacgaagaaagcagatttcagagccacagttgggagaactggacttagcctcccatcactggctggtttcctatgtgaccataggttcagtactatacccttagagagaaagcttctacatatctgtgtgtctctaagataatctgaaccctgacaaaaacacaaattaagcatcaaaagctaaaggaaccattgtgattcagggttggatttggaaagatggtgagtaagtaaagcaaattaatttttatatcattaatcattcatttttctataatttagggagatttcctcccagtgcctaaggagaaacttcagacatggtcatgtggatcacgcctgtaatcccagcacttgggagacagaggcaggcagatctcaagtcagcctggtctacacagtgaattctaggccagccagggctacataaaccctgtcttaaaaaaaaaaaaagttggtgtgtttcagtcattacttggggtaaaaacttactagccatgggccctctgtctgtgcttcctctccagcctgccatatgttcagtattttggaggtgtctctgctctcagtaaacaacagtttcttgccatcaatggattccctaataattattggggttggggaggagaagatgacgacatttttaacaggtaatgctcacagtttttctcttctcttgggctttccttcagtgtttgactccttgcttgattattctggaaggattagcacccaggaggcaagggagtccccacccagcccctgggcttagatccacgctcctgtaggcctgacaggtgctagcagagtctttagaaaaaggagcttctgggattcttaaaggagctttggaagatgtaagatgggagggaaatgaaggggcaaacttactttggcttcctatgtgggctttctgtactgaagaagcaaacccaaagcatcggctgaggagacaggcggctcgctgggtaaagcactttcacctgcaagcacaagagcttgaacgtcacaagccatggagagctagctgtaagcagtgcatgcgtctgtgacccagcatgctctagtgagatggcgtggggacaggacaacccccagatgtgagcgtctcattttcaaagacttgcatctcattatggtcctgatttttttttttataaagcaagtttcatctcacagaatctttgtgccatggttttatttgaattattttaaccaccaacaaggaaagacagattaggggttgtagcaatggcccagcaggtaaaattatatcctgctcttgcagagagcccaagtcttgttcccagcacccatcttacaggcgtctcacaacttcctgtaactccaggtacagaggatccagtacctttttctagactctgtaggtaactgcactaagatgtaaacacacacacaattaaaaataaaaatacatcattttttaaaaagacaataatgccgggtgtggtggcacatgtctttaatcccagcacttgggaggcagaggaagggtgatcttttgtgagttcagtgccagtctggtgtacacagagttctaagacagccagagctatatagtgggtccttatatcaacaacaacaaaaacccagacactagtttaaggagcctgtggaactccctggcctgtgtcctgctgtggccagtcttaccctatccacagcccaggctcttttaaacctggcagacctgtctcctgtaggttttgggtagtgaaagccatctgggaaccaatgtgagcttttacctgacttggtatacatttgataagttaacagaaagtgtctctcagaacaatgtccatgccattcaaggtaccactatgtgagaacttgccaaagctccaagttcttaataaagaccttgacataaacttcatattagagtgcacatattgagtacctactgtatacagaccactgcaaggcccatccagcaaggtgtaagaaacctcaatacaaggttcagacagacacacttgcctacacataatctgacttgggcaagccctctggactgctgtataccacagacctgcccaaagggtcaggagagtttgggaaggggaaagcattgagggaggggctgagaagatgggggtaagtagagggatggagtagctctccaagagataaaggctttatgcacctgttcactgtatgccagacactaaagtaagcccacagggaggacatggtcagaaacgtgtggctcacccacatctgccagtcctcctctaacttggatatttgatgcttcgatttggggctttaatgaggcatacactacaaattgcagaatctgccaatgcaaggtattgggaagtctaaaattaaactaaagactttctgggccatgttccggcatgatggtgagggtttgtgcttcatgaacagcgtttaggcccatgaatgagtccataatgttgcagctgggctatggtaatgactgtccctttactcttggcagattagttcataaaggcatgtctatatcacgtccaaatgctgtagtagggaggtgtcgaatgatccggcattcaagagacaagaaaaatgagcccaatcctcagaggtacgtcctctctgtgccttccctttatttatttatatgttagatttattttatgtgtgtgggtgttcggcctgcatgtaagtatgtgtactgcttgtatgcctggtgcccttggaagtcagaacggttatctgatcctctggcactggagatgtgatccactgtgtgggttttctctgcaagagcagccagtaccatccctccagcccccatgtgttcttgtatttcttcctcctttaaagggaacaggctgtaagtcaggcttttgcacagggccctttaactccagtgaagtagagatattccatctggggtaaccactctgagcaaaagggctgttggggaaatacagatgttggccagtttcttaagatttatgttttaacccatctcctttgcaccttttctctggtaggtttgaccggatcgcacatacaaaggaaacgatgcgcttcgatggtttgaactcacttacctacaaggtgttggatgtacagagatacccgttatatacccaaatcacagtggacatcgggacaccgagatagcatttttagtaccaataagagacctgagaatggccggagacctcagatatgtgtctctgccagttgactgggctggtccctctcatttgtacagtctgaatgacagttcttcttatcattcagatgtccctccagatgcccagggtgagtgtaacatttacccacaacctggctcggcactggatgaaattctacaaggtgagtggagtgtaaaactggtcagcccttggagagacttcttggttgtgtcacccccaaagagtcagaactgtacacagttcaaaacttagtgactgtgggtcacattcccactgttgaaactgctaaattgtgacctggggaaggactttgctttagtcggtgatgttcgtacttggtgacaaattgagactgctgctggattcagattgacaagattttcttggattttttttttatacgaaaatcaaaatttcaatcagtctcgtgctctgtccctttacatcggtatgcgactattacaatcactgtgtgtgtgtcttttcttagcaaaggcgttttaaaacttgagcctggaccttggggtcctgtagtgtgtggattccaaggccttgccctcagagcaggggcctgggcactctcactcacgtggcctgtctccagatccctgtctgatttctgaatgtaaagaggctttttgttttgtttttgtttttgtttttagaagcagttcgtagtatttgaaagaataaatcaagttttgattatgctataggttgatttttgtgttgatccaaatcagaatagctattgagtgtttaagtcatgactttatttttctgggcatgctatataaacttgaatttcctatgtatttttattgtggtattttaaatgtgggggaagggattgggtattttttaggggaaaaaaaataatgtatgctgtagtggtcaaaggagctctgattgagctggcaggccaggttttgtaaagagcaaaattactttcaggtcccttgttgagggaacaggtcagcgttatcctgccagacatctgggtcaggaacttgggagacaacatctgcttacctggcagaactccccactccactcccccaggtgggctgggtggaaggaccctcagccaccaagaactgacgccctcatggccctagactatggggttgaaaactcatagcagtcaggtttgtttaccatctctccgagcctccaccacactccctgacccacccaacgtctccagttcttattgttctccttccttccttctttcctttcccttctcacctctttgcctccttccctaaaattcgctgtggccctcggggtcagactgttcattctccagcatgattgtgccttttaattagaggtctagaaagttcacctgaacccacacccccttcttcctgagaattctggtgcctctaaagcccctccttgccactcagggttttagtgggtgctcccactgctcagtgtacccatgagctgtcgtcattcacagagccctgtgccaggccgtgttctgtgcctgcctgcggtgatgtagccagaagcacgtactcaggtcatcaagccgagagggcgtcaaagaggaagcctgggctgggatccttaggctcagctgtctgtctaatcccagagctaagccctttctgcttcgggcagcctggactccagccctgagtatagaggcggtgtggatggctggccctcatcctacctgtgtctttattgctttgatcaccacagtctctaacttgctgctttctccagaagcctttttatgtatgggttagaaactcttttttccctagtcagagcagccaggctgtacaaaatctgtgctctctcggttccccatgcctctagaaggccgttaaaaccaagactggatgcactgagaggagtctttttttttttttttttttttttctgtcccaagatcctgacttttccaaagtgccttaaaagaagggagacagactcattgagtgtgttgcttctttctctcctaaagcaaacctctgccttttctctatgctgttcgtgttgggttttgttcatgtcagatacgtggttcattctcaggaccaagggaaactgtcttgcctgtcctcctatctcctccctttcagcatcctttggggaacctccagcccaaggcaccgttaggcttgggcattagcctggcccaagagatgccactggggactagaggacagaaggggacgttcccttcacctgggaattctcaccctggtgtcaacatgctgtgcctttctctttctctatttttgttggtgacctggatagtgtggcctttgggacagatcagaggcacaggaaagcaaaggaaatgtgccaccctttagcctggcagggtctccctgcccactgggctgttccagacctgtgatactgtgtttgtatgttgatatcccatgtgtacaaatgtgtttaccattggggctgggggtgggtggctgtctctgaccttggcattcagaacagacatctgtatttttgcctttgaaatgcagtaatataacgtgaataaatgaccttatctttgtaactggcttcttttcttttttgttgggggggagagggggttggagacagcagcaggctccacatgccttccggaagtcagaagtgtccctgtaggaccttcatttttcttatctgtaagtaggaatgataccatatagagaccattttaggcttaaaagagatgatacgtttaaactgatgaccaatacctcacaggtacttaacaatatagtgtctattcccagttcaaaataaaattgtgcctagcagttctctggccacagtctactcctatcctcaacaaatgtcaggatagttgagaatgaatctgagagccatttgtgcaaggaattcacagtgtaagttatgtgctgttttcccatatggagtttcttgccaggccaggaagttgctagccagtggctccaaactagtgagactagagtagagatcagaacctaagggctgcttgtcctcaagaagccaatgaaacaagtcatagtgaaaggcaggaagtggatatttatttagcgtgggtacttaaggggtccagtggcccttccccaagttgtccagtcggtcctaacaaatttataggttcaagtggagggtagaggttgggtactgcaaaacagtccttgtcaaagactgctgccacctgtcaccactgcctccggctccagtctctcctacaaagtcacccgacaagatgctagcagtgtgggacatctccttccaggagacatctcttctctggttgacaagtcagccctctcctccctgcatgagattcctgaggacattgcagttctctggggtgcatcatcacaatggtgtatccctttaagggaggcagaaatgtctccctctcgctcttacaagattcatttttatttttaattgtggttctctgtacgggtgcctgtgggggccaaagagagcatcttatcctcttgagcttggtttagaggaggttgtgagcagcctgaagtggtcctgggaaccatacttgggtcctctgcaagaacagtgcgtgctcttaacgactgagccatctctttagccccaaaatgtctctttagtatataatcattgttccagtactattagaaaaggatcttagttgttaccaggtacttaaggcaatatattccaggtgtgtcctcttttatcccgtgagtcaggcaccacggcctcttacaggttgactggtagacttgaaagaggccaaaggaaggcggtgcaccggagaggctgttgtggctatcctgtaagaatgagcaaggaaagaagagcaccagccatccagggccacctaggttgtctatgctactggaagaatctttagtggcctttggcgtgagcatccatgaaagatgactagatgtagccttcaaacatggtgtagtgacctcctggcaccgtgctcttagagacttaatggaaaaccagtgtattttccttatctctcacccctcagcacttcacacctgacttccaggtgttcggactctctccctgccaaacaagcacttccagtaggatgacctctagagtaacttattctattatcatttactggattcggaattgcatgccatctggctaaggactcaaccacaagactgccctatctccaaaccattggcaagcagcaggtcgtggcctgtgctcctgaccaactggctagacattcccagcatctttactgcagcctcaattcatttgccaggatgagtcacagaactctgggaaatatacatttatagcttattacaaaatgatagttccatccagccatggtagctcaggcctgtaatccctgccacttagagctgacacagaaggatccccaaaatctgaggcctgcctgagcaaactagtgagacccccacccccatcccaaaaatatagggggaaaagaaaggccgaggatagagctcagcggaagagcactcgccttgtgtgagaccctgggctcagtgattggactggggaggtagcaagttcccatcatggttttatcttcctaatggccagttcccatccaggagccaccttgctagaacaagggcatgcctgtcctgcaggagagttcgaggaatgtgagctgtggcagaagctaagtatgagatcaaaagattctagccctgctattgctaagaaaagtaggaaagtgttacggtgcctatgccagaaaccaggacaaagaccaagtgtatgtcccatcaggctacagtgaacacaggccttggcaacctgtaaggtctggatcaagctaacagaaatcagtagaaatgagtaggggctcatagcatgtaactcagcactcaagaggctgagacaggaggatcactgactctgagaccaagggcaacctggagaccctggaacttcttactctgtcagaaaagaaatgagatctggcagagccagtcctacaggggagccatatttccttgttcgaacttgtcctgggcagggaatgtggctgctgcattcctctgggtatgaaccactcaaaaggtcaggaggcagagaaatctctgtgggaatggtgttacagggtaataacgtcatccgaccaaagctcagaggtacttgaagagaaagtatatacttcagcaagacacataccgttgaggataaagggcaaaaggatgtcacagagcattagagaagtaggtgggacagaaaggtagaaaggtttaagggccctatgccagaaatcatcatgaaaaccaagcatgtgtcccaccagaccacagtgaacacaggccttagcacactgtcttagtcagggtttctattcctgcacaaacatcaagaccaagaaacaagttggggaggaaagggtttattcagcttacactttccacattgctgttgatcaccaaaggaagtcaggactggaactcaggtcaggaagcaggagctgatgcagaggccatggaggaatgttacttactggcttgcttcccctggcttgctcagcttggttttttatagaacccaggactaccagcccagagatggtaccacctacaaggggcccttcccccttgatcactaattgagaaaatgccttacagctggatctcatggaagcatttccccaactcaagctcctttctctgtgataactccagcctgtgtcaagttgacacacaaaaccagccagtacacacaccatacagatatgaaaccataccatggtcattactactggtctggctttctctgccttctcccttgctcattgactctgggcaagtcaactttcctttctagacttctatttgctcttgttttttatgagctgccctcagaacccacccttggtcttctgtgtaattctgccctccgacagagaacttcccagaagttatctggtctgacctctgtgatctggaggaattcactgtagttctggccttatccatgaaaccagctctccaaatctgtcctccacccactctccagctcagcactcaattcccatctgactaaaggacggttggttgtaagtacgtcatagcctcacacaatctagcttccctagggaagaaagggtatttgtcttagtaagagttagcaaactctgggacagagtgtcaaactggatttagaaaccaagctgagcctctagcatctgtcagtcctttggtggcaggccctgagtggccagctgacctcttttaaacttcctagtggatgcctttgtgtcccactggcagaccccctgctgatggatgagctcaacaagtcccaggctgcatcaggatacagttatacatttgtggaccaatcagccaacctgtctcttttcagactgaccaaccctaaagtggtggtggtggggaacttcagagactggctttgcctggctttcttggtctgagcgccccttgctttgcagagggtccttttctccgagtgcctgctgcatgtgtgtgttttctcacccacaataaacaccttccttccactgttgctgctgtctgctgtgtttgtgatttctccgcttttgctttggagaattttacctaccttttaattctttaattggcagaagaagtgaacccaatcaagacccctagactacattaatgccatatgggaacagctcttctgggaatggctgatgaagacataagtcttaaaatcaggctggccccacaattctcattctaggaatttagttactccctcccccaagatgtacacccccctgctgttaaccctgggaaatgaggagatgccatcaagagggggctttgcctaggaaaatgaagtatggtttaccaaagctatagagaataaagtggacctggattcatttattggaaggaggcctaagggggaaaaaaataaaacagactattttcatatacaacagggagttgtgtcaaatcctactccctttaatggagatattagtgtgtaattgctggtaggagtgaaagcaaaagcagtagactgtggatgcgcttcacctcccttcccagactagggctaggctcttgttctgttctatctacctacatggttcaggaaccgccaacactgagaaaataagctgaatgccgagcatgtagcatgtataaagccccaagttctcaatcccaaacatgcaagagaaaacaagaaagtgtggtagtgagagtcgggatggataggcagagggaggaggtggacagacaggggaggggtccccctggaaagctgcaagttttaaacacctgggaagagaggaaggcttctgtgtgtgtgtgtgtgtgtgtgtgtgtgtgtgtgtgtgtgtgtgtgtgtgtgtttgtgtgtaagagagacagagacacagagagagagagagacagagaaagagaaggagagagtgggggcctgagtcctgttcacatgtgttgggatgtggcatcactgtggaatccctgaggagctcagtgcaggttgaagagacttctagaaatttcttgcctctctcccaggtgcagcagacccccatgcctgtttcacttttgcattaaaaactttaaaaacacaaacattggggagggaactccgagtcctgggtctggaggagcaagaccctccattggctggtggtccttgatcatgggccctagaaggaacaacagcctgggagaaagtaagcagactccattcccagcagagccttggtcttagaatccaggaaccctggactctgcccaggcagacccagaaggaacaacagcccgggaggaagtaagcagactccattcccagcagagccttggtcttagaatccaggaaccctggactctgcccaggcagacccagaaggaacaacagcccgggaggaagtaagcagactccattcccagcagagccttggtcttagaatccaggaaccctggactctgcccaggcagaccctgacatctggattttgatatagacttgagccctagagctatgggagattcatttcctggccagatgtaaatacagaacattgggcttgtgctcctgtacttagtccctgctgaggcatgtgccacagcatgaccaactcaagggcatgcccttatctttgaagcctgtgtgatagggtgcaagagctatgtgcctggccttgccaggcttctctcagttccatggaacccagccagctggagcttcctgcatcaagagccttagacatcaggccactagaagtatccagtcaaggccaatgggacattacaagggccttcagagcacctcctgcataactttggtctcctttgatgacaacaggacaggagacaggccagctgcaacaccctcttagttcccagcttcacaaaagccacacacctagagggaggaaatgttggggagacactctaccacatgagtggctgcacacctataatcctcccctgctcagcaatgcttcttatagtaaccccatcactggatactgaggctcaaagaggttacatatcctacacggggtgacccagagttagtgcctgacacagacccttccttcttcatcagccctttagccagcttcttcttcttcttcttcttcttcttcttcttcttcttctttttttttttgaagtcatatggcttttattacctagactcagaactcatattctgatacacacacgcacacacacacacacatatatatatatattcccattgggtatatatctaagttttaccttagtatggaaaggagcttcagacagttttggataccaagaaataagggttattccaatttcctaaaatattaaatgggaatatgttctagatctgggctttgtaatattttccattcacaacacctttgcacccaagaaatgtttatttgactcttggcatatgtataggtatgtatatctgtatataaaacaggtatttaataatcataagtatttttagccagcttctttagccctagccataccactgtggagtaaagcgaagtaaacaaggagaacaatgacactgagaacccacatggacctggaacaatgtggttttctgcttcttaaagttcactgtgaacagcaacaccaatgcccatccctggttcacagacaacatagctcctctattctcttggactgtccctgccttgagtcaatacttgtcctggagggctcagtgtagaatctaccacaaggctgcagaaacccaaagcggcaagtgaagagatgctgtcttaattagggttttcattgctgtgaagagacaccatgaccaaggtaactcttataaaagggcaacatttaattggggctagcttacaagttcagaggttcagtccattatcatcagggtaatcaaggcgggaagcatggcagcatccaggcagacatggtgctggaaaaggagctgagagttctacatcttgatccaactgcagccaagagaagcctggcatcttcaggaagctaggaagggggtgggggggcatccgtcaaaacccacccccacagcaactcacttcctccaacaagaccatagctcctaatagtgccactttctgggccaagcatattcaaaccaccacattccattccctggcccccataggcttgttcaaacacatgagtctatgggggccatatctagccatagtataatgcaaaatatgttttgtccaatttccaaagtcccatagtccataacaatctcaacaatgttaaaaatccaaagttcaaagtctcttttgagatccatccaatcacttacctgcaatcccctataaaatcagaataaaaaagcagatcacataccccttatatcacagaatatacattaccacttcaaaacctcataatgaggaaatattggaccaaagcaagaccaaaatttgggcaacttccaaactctgcacctccatgtctgaagtagaagcattcttcatatcttcaactcctttacctgtttatctcctcaaacacagaatttagctccattgcactcctggtgtccttttattacttgaaccatagcttttgtatttttcctttctaagcttgctgctacacttgatcaaaatgcttttcatgagagtaaaccagaggacaaagtctactctggtggtttttgagacttcctttgtcagtgcaattaatcaaaatctctttaccttagccacacgtggactcttcagacaagggcaaaaaccagcaacattatccaccaaaacatcataagaatgatctccagggttcaaatcaccctcaacaccaatgtctccctatttctcctaggagggctcattaagtcccacctacagcattccatgggtttccaaattcaaagtcccaaagtccacaactcctccaaagaaaagcatgttcaggcctatcacaacagtatcccactcctggtattcttttttttttttttttaattttctttttctttttaaagatttatttatttttatgtatgtgagtacactgtagctgtcttcagacacaccagaagagggcatcagatcccattacagatggtttgagccaccatgtggttgctgagaattgaactcagggcctctggaagagcagtcagtgctcttaactgctgagccatctctccagccccctggtattcttttttagttaggatttctagctgtgaagagacaccatgaccaagacaactcttacgaaggacaacatttaattgggactagcttacaggttccaaggttctgttcatgatcaccatgttgggaagcatggtgctagagaaggatctggtttttgcccttgtctgaagagtccagacaggcatggttctagagaaggagctgagagttctacatcctgagccaactgcagccaggagaggactggcatcttcagccagctagggggatgctctctcaaagcccacccccacagtgactcacttcctctaacaaggccacacctcctaataatgccattccctgagtcaagcatattcaaaccacacagatgccgttcctcagcatccccaccatcctcaagctggatccccactttttctcccttccctttaagccgcctctcctcagtaccacgcatcttttttccagaaggaggataagtagcactctcttccttaaacttctgcatggtcccagctgaaggcaattttgggggtttgttttgattttagcaagtcaaggacctgtggtttgtttttgagtcatgagctgaatgatggccttaacttcatcagctccatcaggtctgactgactcaggatccatgtggctcactctagatacttacccagccacaatgagactatggaatgaatgagagaagggctgtatgttgagagcaagagaaacctcccttatgaccaatatgtctgttgggccagctgacccagacaccagtccggagtctcttctagttatttggttttagattctggaacacgaaactgaggtggttatcttaccaagtcagacctggcctccaggttctcccagcatccctcagtccctaccctgcccctaaccctgaactttccagcacaggggctgggatacccttctcccagaggctcttctctatataatccagacattttggtctcctctctctccgtctctcaccgagcatgttttctttctttctttctttctttctttctttctttctttctttctttctttctttctttctttctttctttctttctttctttctttctttctttctctctctctctctctctctctctctctctctttctttctttctctctttctctttctctctctctctctctctctctctctctctttctttctttctttctttctttctctttcccctcttctctctatctcttcccatggtgactttccctggcctccttccttggggttagtgaattcacccaagaacagcttcccaataacctaggattagtataatctgatctgccttgaattggctcattgcaccggtggagaaataacttactactagtatctaagagtgctgagattgtgtccttacatagtccatggcttggctgttgacagtttgcttgctggggttcagccctgcttgctttatgtgtctgggtgctgtccctgttttgttcctactctgtagcacagatacactacccacagtttccaagagctctagggctcttcatgggatcgagggctgtcaaccctatttgactcctctctacctctgaagacatgacatatactagcccactgattgaatgtcttactttggagggtatggaccatagagggagcagaggaagcctggaccagagtgaccaaggccgggtcatctcagaccctcatctgggcagcagcaaggtggtgagagatctaactgcaagcttgtggttctcagaaagctcaggggggtctccaatttactcctctaagtgctgtaaccagactaaggttgtgaggcctaaaacaagagtcccatcctcctgtaaaacctcagggtcagaaacaaaggtctattttggcaatccaggaagcca

SEQ ID NO: 2048 - DNA, 3953 bp, Mus musculus
ggccaggggtgtcggctttccgccgcaggcggccggtgctgcgctaggtcctagccccctccccccggcccctccttcgatcgctgtggtcgggtagcgcctggcgggcggcctgcgggcgggccgtcctctcagccgtagcccaccccctcttaaagccgcggcgggaagatgaggtttcgtgagcagttcctgggcggcagcgccgcgatgccgggcgcgaccctgcagcgggcctgccgcctgctcgtggccgtctgcgcgctgcacctcggcgtcaccctcgtctattacctctctggccgcgatctgagccgcctgccccagttggtcggagtctcctctacactgcagggcggcacgaacggcgccgcagccagcaagcagcccccaggagaggcagcggccgcggggtgcgcggccgccgcctcctttaggcgtctccccgaagcctcgcccgggtctcgactccagccctggtgcagcttctggccccggcttgaagagcaacttgtcttcgttgccagtgcccaccaccactggactgttgtcgctgccagcttgccctgaggagtccccgctgctcgttggccccatgctgattgactttaatattgctgtggatctggagcttttggcaaagaagaacccagagataaagacgggcggccgttactcccccaaggactgtgtctctcctcacaaggtggccatcatcatcccattccgtaaccggcaggagcatctcaaatactggctgtattatttgcatcccatccttcagcgccagcaactcgactatggcatctacgtcatcaatcaggctggagacaccatgttcaatcgagctaagctgctcaatattggctttcaagaggccttgaaggactatgattacaactgctttgtgttcagtgatgtggacctcattccgatggacgaccgtaatgcctacaggtgtttttcgcagccacggcacatttctgttgcaatggacaagttcgggtttagcctgccatatgttcagtattttggaggtgtctctgctctcagtaaacaacagtttcttgccatcaatggattccctaataattattggggttggggaggagaagatgacgacatttttaacagattagttcataaaggcatgtctatatcacgtccaaatgctgtagtagggaggtgtcgaatgatccggcattcaagagacaagaaaaatgagcccaatcctcagaggtttgaccggatcgcacatacaaaggaaacgatgcgcttcgatggtttgaactcacttacctacaaggtgttggatgtacagagatacccgttatatacccaaatcacagtggacatcgggacaccgagatagcatttttagtaccaataagagacctgagaatggccggagacctcagatatgtgtctctgccagttgactgggctggtccctctcatttgtacagtctgaatgacagttcttcttatcattcagatgtccctccagatgcccagggtgagtgtaacatttacccacaacctggctcggcactggatgaaattctacaaggtgagtggagtgtaaaactggtcagcccttggagagacttcttggttgtgtcacccccaaagagtcagaactgtacacagttcaaaacttagtgactgtgggtcacattcccactgttgaaactgctaaattgtgacctggggaaggactttgctttagtcggtgatgttcgtacttggtgacaaattgagactgctgctggattcagattgacaagattttcttggattttttttttatacgaaaatcaaaatttcaatcagtctcgtgctctgtccctttacatcggtatgcgactattacaatcactgtgtgtgtgtcttttcttagcaaaggcgttttaaaacttgagcctggaccttggggtcctgtagtgtgtggattccaaggccttgccctcagagcaggggcctgggcactctcactcacgtggcctgtctccagatccctgtctgatttctgaatgtaaagaggctttttgttttgtttttgtttttgtttttagaagcagttcgtagtatttgaaagaataaatcaagttttgattatgctataggttgatttttgtgttgatccaaatcagaatagctattgagtgtttaagtcatgactttatttttctgggcatgctatataaacttgaatttcctatgtatttttattgtggtattttaaatgtgggggaagggattgggtattttttaggggaaaaaaaataatgtatgctgtagtggtcaaaggagctctgattgagctggcaggccaggttttgtaaagagcaaaattactttcaggtcccttgttgagggaacaggtcagcgttatcctgccagacatctgggtcaggaacttgggagacaacatctgcttacctggcagaactccccactccactcccccaggtgggctgggtggaaggaccctcagccaccaagaactgacgccctcatggccctagactatggggttgaaaactcatagcagtcaggtttgtttaccatctctccgagcctccaccacactccctgacccacccaacgtctccagttcttattgttctccttccttccttctttcctttcccttctcacctctttgcctccttccctaaaattcgctgtggccctcggggtcagactgttcattctccagcatgattgtgccttttaattagaggtctagaaagttcacctgaacccacacccccttcttcctgagaattctggtgcctctaaagcccctccttgccactcagggttttagtgggtgctcccactgctcagtgtacccatgagctgtcgtcattcacagagccctgtgccaggccgtgttctgtgcctgcctgcggtgatgtagccagaagcacgtactcaggtcatcaagccgagagggcgtcaaagaggaagcctgggctgggatccttaggctcagctgtctgtctaatcccagagctaagccctttctgcttcgggcagcctggactccagccctgagtatagaggcggtgtggatggctggccctcatcctacctgtgtctttattgctttgatcaccacagtctctaacttgctgctttctccagaagcctttttatgtatgggttagaaactcttttttccctagtcagagcagccaggctgtacaaaatctgtgctctctcggttccccatgcctctagaaggccgttaaaaccaagactggatgcactgagaggagtctttttttttttttttttttttttctgtcccaagatcctgacttttccaaagtgccttaaaagaagggagacagactcattgagtgtgttgcttctttctctcctaaagcaaacctctgccttttctctatgctgttcgtgttgggttttgttcatgtcagatacgtggttcattctcaggaccaagggaaactgtcttgcctgtcctcctatctcctccctttcagcatcctttggggaacctccagcccaaggcaccgttaggcttgggcattagcctggcccaagagatgccactggggactagaggacagaaggggacgttcccttcacctgggaattctcaccctggtgtcaacatgctgtgcctttctctttctctatttttgttggtgacctggatagtgtggcctttgggacagatcagaggcacaggaaagcaaaggaaatgtgccaccctttagcctggcagggtctccctgcccactgggctgttccagacctgtgatactgtgtttgtatgttgatatcccatgtgtacaaatgtgtttaccattggggctgggggtgggtggctgtctctgaccttggcattcagaacagacatctgtatttttgcctttgaaatgcagtaatataacgtgaataaatgaccttatctttgt

SEQ ID NO: 2049 - protein, 352 aa, Mus musculus
AACPSWSESPLHCRAARTAPQPASSPQERQRPRGARPPPPLGVSPKPRPGLDSSPGAASGPGLKSNLSSLPVPTTTGLLSLPACPEESPLLVGPMLIDFNIAVDLELLAKKNPEIKTGGRYSPKDCVSPHKVAIIIPFRNRQEHLKYWLYYLHPILQRQQLDYGIYVINQAGDTMFNRAKLLNIGFQEALKDYDYNCFVFSDVDLIPMDDRNAYRCFSQPRHISVAMDKFGFSLPYVQYFGGVSALSKQQFLAINGFPNNYWGWGGEDDDIFNRLVHKGMSISRPNAVVGRCRMIRHSRDKKNEPNPQRFDRIAHTKETMRFDGLNSLTYKVLDVQRYPLYTQITVDIGTPR

SEQ ID NO: 2050 - DNA, 76670 bp, Homo sapiens
aggaaggaggatgacaacacagcgaggaagttgttgggaaattattcaggacctaagtgacatagtagtaacatgtagtaacatggataagagaaaataattgaacttgccgccttggtatggagatttctaggcaaaatgttcaaaatgccaacttactccctttggctgcctgtgaaaaagtacaggaagaagaaactattttgtttcaagcaaaattttgagaaactatagagggcccagggcattatatacagccagaaaaaagaaatgctcaaagtaaattaaaacctagagggaatattaattctaagaccttccccgtaaaatggggccttaaggtcacggatgtggctgtaagacttttttgttgccgtttctcaaatgttatattagttattttttgtactctattagtatattattggcatatagtaatatatgggtagcaatttaaaaaaaaatgttagatttgggggtacgtgtacaggtttgttatatgagtatattgcatgatgctgaggtttgggcttctaatgatcctatcacccagcaggtagtacctgataggcagtttttcaactcttgtccctccacctctgctggagtccccagtgtctactgttcccacctttgtgccgagtgtactcaatgtctagctcccacttatcggtgagaacatgtggtacttggttttctgttcctgcattaatttgcttaggataatggcctccagctgcatctatgttgctgcaaaggacataattttgttcttttctatggttgtaagactgttgagatctcagaaagccttaaaacagcgcctcctaaacctctcatgtagactaaagtgcttctaagagtcttaaagttttggttcacagcactgtaattcacagcctaaaggagggaagggcttatcttgagatttgggggtatggtttgagtaaaaataaaattaacggaaagtccacagttttttcccctacaagaattgtaccagtgtaagcagtagtggcttgagctaaaacagacaaagatagttcaacatgaaaagagcacaccgggtacccagtgaagcatcttgaacaagttaccggactgtgaacaaagcctatttcttttggaaaaggaggaatgactcaaaggatggagccaagagctccatccaagggtagagataagagccacagagaatcacattccctgcccctggagcagggggagctggtgacaagtgcatggttagttctcacatttgctaatggctgttatgtgcctcttattaatctcctattctaaatgggagtgtctattgtggttttcttgtccttgtatttccattatatgttagacgtgtgggggaaaagtcacttaagtaaaagttgcgagtttagtacaaataatttgtttagactacagtcatacgttgcttaatcatggggattctttctgagaaatgtgtcgatagtcaattttgttattgtgcaaacatcaaagagtgagtctaaatccagatggtacagcccactatacatcaaggttatatggtatggcctattgctcctaggctacaaacctgcacaacatgttactgtactgaatactgtaggcaattataacacaatgataagtgtataactaaatatatctaaacatagaaaaggtacagtaataatacactgtaaaatataaaaaatagtatacatgtacagggcagctttattataatcttatggacccatcatcctatatgctgtccattgttgactgaactgttgttacgtggcacatcatggtatttgagagtaaatttccgatatgatgccctattactccaaaacccttttgtgtatatttccagtgtaaccacaatataatcatcaaaacaggaagttaacatggctacattattatcattttatgcttagtccccatccaagtttcactggtcatcccaataatattcttttttttaatttttaatttttttagtgacagggtcttactgtcattcaggctggagtacagtggcttgatcatagcttactataacttcaaactcctgggctcaaatgatcccctgcctcagccttccaagtagctaggactacaggtatgcaccaccatgtccagataatttttaaaatttttcatagagacaggggtcttgctatgttacccaggctagtatcaaacttctggcctcaagcagccttcctgccttggcctcccaaagtgctgggattataggcatgagccaccacactaggcctccaattttatatatatatatatatatatatatatatatttttttttttttttttttttttttttttttttaagacagagtcttgctctgtcgcccaggctatagagtgcagtggcgtgatcttggctcactgcaacctctacctcccaggttcaagcgattctcctgcctcagcttcccaagtagctgggattacaggtgcacaccaccatgcccagctaatttttgtatttttactagagacggggtttcaccatattgtccaggctggtcttgaactcctggcctcaagtgatctgcctgtcttggcctcccaaagtgttgggatttacaggcatgagccactgcttctggcccccaataagatatacatataattttgagacggagtctcactctgtcacccaggctggagggcagtggcacgatctccgctcaccgcaacctccacctcccaggtttaagcgattctcctgcctcagcctcctgagtagctgggattacaggcatgtgccaccatgcccagctaatttttgtattttcagtagagatggggtttcgccatgttggccaggctggtcttgaacccctaacctcaggtgatctgcctgcctcagcctcccaaagtgctaggattacagatgtgagccaccatgcccagagaatattctttataataggaggatccactttagaatcacatgttgcattgtttttttccttcagtttttcatttttccaaaaattacaccaagctaaagcaaagctctagttgaggtgggtgtgttgtgtagacgttagcagtactgccctcactacatgctctttggacagtagtgcaaccccaagaaaaggatggttagttatttctctttattttccttcaattgtgatgagaacattttcttgacattctggaagatttcaggatggttattttctagaatgtctcacaatttggatttctctaatgtttcccattaaaattattagcatttcttaaggcagtatttgaaattaggtaaatatattgctactcatcaaattccatttatttatatcattatggactcatagtttattttgttcaactggtaatagtttctatcaatatttattttcattctcaaatttttccatatttggccaatgggagccccttcaaactgatttctgtgtctttttgacataatcttatcattctttgagttcttcctcactttctgacacaagagtttccaggttcatcttgtaatattcctagccagtccctggaatcagcaatcagccttttctccaagaatacctaggtccttttattggagaatggtgtttagaaaccaagacttggctgctagatgtgctcatggccttgggaaatttctgctcccagacaatacacacacacacacacacacacacacacacacacacacaccattcttatttcatctatcactatattgaaaataatgaattcacaccaatttctcaaatttaaataatgtatcaaaggattcattttagttttctccctgtctatatttgtaactcctctgactgtcagaaacttgggtaactctcatctatatatagttgctttttttttttttgcttttttttttgagacggagtctcgttctgtagaccaggctggagtgcaatggcccgatcacggctcactgcaacctctgcctcccaggttcaagtgattctcctgcctcagcctcccgagtagctgtggattacaggcatgtgccactaagcccagctactttttgtatttttggtagagatggggtttcaacacgttggccaggctggtctctaactgctgacctcaggtgatctgcccgccttggactcccaaagtgctgggtttacaggcgtgagccaccatgcccgaccatatggttactttttaatcagtgttgctgtgttcaacactctcttcatcacatcttggcttcaacaccctgtactcggttgccctacttcacaggagacttcctaccatgctcaggtcctgaggccctttttgctctcctgggctttgaccctctttgctgggctgctatcctccccacccccacccttacccctccctatcatggttgggctttgacaccctgtctatgctgtttggactcttatgttgctcaaccctacctagtgactttttaactgaatttctcaggaaaagggagaaaaaaaaaaggaatgaggtaatttgtctttataatccacaggtccctcttttatctttattttttagagatgttacccaggctggtctcagactcttgggctcaagtggtcctcccacctcaaccttccaaagcactgggattaaaggcgtgagccactgcacccagctatccgtatctcccgtccctgaacctgaggaatatacctgtgaaactgtgtcccaaagagttaaagaaaacaatgactaacagaaattcctgagtttgcaggatggcagataagaaaagaaacaatgtgctgaaatgccaaaactccctctgcttgagataaaagaactggctgaaatcagttggaacaaacagggcaactgggctgttcacagaaagagctttctggtgtcacaacccaaatttccaccacgtttcattctaaatccccctgaattgcacatgtgaccagtgaagaggcatgaagaaataattgtgcatgactgaggactttccagacctcccctttccttccaccagttacttactaatctcagaatccaccccccaaaatttttctgataaaaacactaccttaaagccagcccagggagacttgagccagcccagggagacctaaagtcaccacagggagatttcagctggactcttctatctccttgttggcctacctgcagtacaaagcttttcttttctcaaaaaccaggtgtcacagtattggtttctagaacattgggcagtgagtgcttttgcgctttggtcggtaacacctggatctgatttagacaatactttggacctgaagtcttaattagttgaacttttgggggattttaagaagacactaatgtattttacctgtgagaagaatctaaataatctgtggccattgggcaaactactgtggaataaaggtgcctgacaattctttgtccctcctcccatcaagaggtggagtcagccaggtgaaatggctcatgctggtaatctcagcactttgggaggccaaagcaggaagactgcgtgagctcaggagttcgagactagcctgagcaatatcgcaacatctcatctctactaaaaattttaaaattagctggacgtggaggcgcatcccggtagtcccagctactcgggaggctgaggcaggagaatcacttgagcccaggagtttgacgttatagtgacctatgatcacaccactgcactacaggctggttgataaaggaagatcctgtctaaaaaaaaaagtaaaaacaagaggccgagccagttttattccccttgaatctggcctgccctataaacttgttttaagcaaaagaatgctttagaagtgatgctaaggctgggctttcagggatctccatcttctgtatttttgaaatgctcctttttggaatgcttcctctagtttgtgaggaaacccaagcagccacatggagagtcctttgtggagagatccaagtggagaatgaaggccccatgacccaacccattctgagtttccagcccccagacagccccaactgccattcacatgagtgaagccattttggaacttccaactgtgccagtgcctcagctgacaccatgtgaggcaaagctgcccagccaactgcaaaactgcgagaaattgttgcttcaaaacagtaagttttggggtaggtgttacgctgcaatagatgactgaaataactgtctaccatgtgccgggcactatttgatgcccttctgatccatgagggtaaaaacagaaatgtaacctggcaggtgcagaagagggcgccataggagggcagaggaaggccagctgcagggagaagcagggagctggtgattctgggcagatgagcacatggatgggccaacggccaagcccccatgccagcttttggccaatcagcactgcaacttcctcctgcatttgtctcgccggatgggattaatttttcacctgacgaagtagagagtggaaaagagctggagacagtggggagaaaggttgcctgggtctgtctcactagcaccagttaatgtctggactgctggacaatgttgtcccaaaggtttctgggccatctgtattatttgtaattgactgcttctaggtgcctgtggatcaggggcagctgagactagtgctcaggcctcagtggactctgcaagttcctgagggataggcaatcagcaagtgttgttccttttcctcgatttctggccacgtgtgtcctgggacaggtctgtgattcttaataacccccgcagtcctgtctcctggctatcatctataccaatggaagacacatccccatttccccctccacttaattttcagttgcaggactaatctgacccaccctcactcattggccaggccgactttacccctagacacaggatgctggggtcagcttcacctttaccaactccttggagaactccactttacgttctaaactaagttagcaataatttttcccttctctccttcccacatcattaagatgatcacagtatttaaaaagtattttaacaaatatcggccgggcacggtggctcacaactgtaatcccagcactttgggaggccgaggcaggcagatcacgaggtcaaaagattgagaccattctggataacacggtgaaaccccatctctactaaaaatacaaacaaattagccgggcatggtggcaggcacctgtagtcccagctacttgggaggctgaggcaggagaatggcgtgaacccaggaggcagagcttgcagtgagccaagatcacgccactgcactccagcctgggtgacagagtgagactccgtctcaaaaaaaaaaaaaaaaaaaatctaggggctgaagatacagtagtgaacaagagagaaatttcctgttctcatgaagctgattttctaatgagggaggcaagacaacagaaaataaatgcataatgttgggtagttgatatccactctgaaaaaaatcaagcaggttaaggccgggcgcggtggctcacgcctgtaatcccagcactttgggaggccgaggcgggcggatcacctgaggtcaggagtttgaaaccagcctggccaacatggtgaaatccgtctctactaaaaacacaaaaaattagcccggcgtgatggcaggcacctgtaatcccagctactcaagaggctgaggcaggagaatcgcttgaacccgggaggcagaggttgcagtgaggtgagattgcaccattgcactccaacctgggggacaaaagcaagactttgtctcaaaaaaaaaaaaaaaaaaattcaagcagtttaagcagatttgggcaggaggccattctgcataaggtagtctgaaaaggtctctgtcataaggtgacatttaagagacctgaattgaatgaaatattggggacaagtgtttcaggctaaatgaacagcaagtacaaaggccctgaggcaggaagaaatatggcaagttcaaggaatagctatcaggctagtgtggctaaggcaggtccagcatggtagagtgacagatgtgggtggggagggaaataggaaccagattgaacagggtttctgtggatttggttctgaacaaaatggcatgatctgatttatgcttacaaagatttcctggatgctctgtggaaaacagactagggaggaggaatggaggaggtggaagcagggtgaccaattagtagctgccatataacccagggcaagatgatggtggcttgatcgaggatggttacatcagagttggctggtggtgaatattgatgttttgaaggtagcactgacaaagctggctgagggcttgcaaatggcattgagagcaagagaagcacatcaaggacaccttttagattctggggaactgaataaacaatagtatcactctctgagggaggtaagaacgggagtggtgtgtaaggagtaggttgctgagggcaagatgtattgtgtttgagatgccagtaaaataagcagttgaatctggaggtcagggaagagatctgggctggagacaaatcagtgatcagcatttggatattataaatcattccgaggcagtaagtgtagacacaaaagaacatcatggactatggctggggccttcagcaactggggaagaagtccagagaggagacagaaatggccagtgaagtgaggaagatcagaaggacctggtgtccaggaagtcaagtgaggaaagttgattctgtatgatcacaaccaaagtgtcaactcataagccttattttctcatctgtgaaatggacaccgtaacaccacctacttcatggcagatagtactggcacacagcaaactctcaaaataaggtagctactgttattccctgctggttggctgccagagccctcaacttccctatccacattactgacagcacctccatgagtctttctctggggtgaggtgtctctgctcactcagggcctgaggcctctgggtcaaatcgaggtcaagtggcttcagtgcctaagtctctcacccacacagccttcagcccttacttgcaaatcaacaaagggtaaacctgtagaaaacatgggtttcggagccagaattctgcctcttgccagctgtgggctcttaggaaagtttcttaatctgccggggccccactctacgacatggggagaactgctacttcatgggacagtgggtagcccagtgtagactgtaacgccggctgatctcctgcacgctggcctgggagttagaggcttcttgctgctctcctcttcaaagtatacaggactcccgccacacacacatctggaaccaagctggtctgagagccccttatagcccaggctacctgatggggaggcacagaagtggcaacccgtccactttctttgccgcaggaccccccgttaagcagcggggtccagccgggctgagttagggagggggtttcgaacgtgccactcctcgcccggcgtcgaagcccgtttcctgggtaacctttttctgcctctcttcctagcccaccaaggcccactggccagaacgccgccgcggccccaaaccactccagataaccacccgccagctgtcctctccgttctctccgccgccgcgctgcaggcccaggctcgcacccgagtcccttcgcaccccaggaagtggcgcggcctgtcgagggcagcgtggaggaggaagaggaggcgcggctcaacgcgaccgaagctccgccgcaaaggctcgggaggaagagggcggtgcgcggccaagcgtcggagctgcagtcatactccggggaccccacgacggcgccccgcccgctgcccaccctcccgaggccccgcccagcgcgcccatcccgccacgggctgccccgccttcccgccctcgtccagaaaaccccgcgcccggccccgcccccgccttcgccggggccccgcccctcccctctccgccggcgcctcgggcggcttctcgccgctcccaggtctggctggctggaggagtctcagctctcagccgctcgcccgcccccgctccgggccctcccctagtcgccgctgtggggcagcgcctggcgggcggcccgcgggcgggtcgcctcccctcctgtagcccacacccttcttaaagcggcggcgggaagatgaggcttcgggagccgctcctgagcggcagcgccgcgatgccaggcgcgtccctacagcgggcctgccgcctgctcgtggccgtctgcgctctgcaccttggcgtcaccctcgtttactacctggctggccgcgacctgagccgcctgccccaactggtcggagtctccacaccgctgcagggcggctcgaacagtgccgccgccatcgggcagtcctccggggagctccggaccggaggggcccggccgccgcctcctctaggcgcctcctcccagccgcgcccgggtggcgactccagcccagtcgtggattctggccctggccccgctagcaacttgacctcggtcccagtgccccacaccaccgcactgtcgctgcccgcctgccctgaggagtccccgctgcttggtaaggactcgggtcggcgccagtcggaggattgggacccccccggatttccccgacagggtcccccagacattccctcaggctggctcttctacgacagccagcctccctcttctggatcagagttttaaatcccagacagaggcttgggactggatgggagagaaggtttgcgaggtgggtccctggggagtcctgttggaggcgtggggccgggaccgcacagggaagtcccgaggcccctctagccccagaaccagagaaggccttggagacttccctgctgtggcccgaggctcaggaagttttggagtttgggtctgcttagggcttcgagcagccttgcactgagaactctggtagggacctcgagtaatccactcccttttggggactgacgtgaggctcccggtggggaaggagactgacctctcggttcacgtgtcttgccatagagccactctcctgagtgggtttttctcctgatcgtttgggccaagtgacttctctctgaacctcatatttctcttctgggataataaatggtcaccctttcaaggggttgttttggaagatattgtgaacaatggtaaataagggcttaattaatgagggtaagccctcagtaaattgtcactgtgtgttcatttcttcctctgtgtggatcgtgaccgagagcccttccccctagcctcctcctggtatgggtacccaaaacctaggtgagcagggatctctcccaggggcagagagcttgtgtactctgggtgctagagggctaaaatataaccagtcaacaccacgttgcccatttctggtacttccggtagcagcctgagtctcaattatcttgcccagatgatctgaactctgacctctagcctgtttcagcataggcagagagcttgagtaggtgagtttgcattcctcatagcagctggctgagcctagtctggacttctctttgacctgtaacctacaggcccacaggcccaaggcaaccacaggttgcttccagggttaccacacaggtggtttctcatttctaatgctaggttttagataattgttgtaagtgaggggccctggcaggcaggatgacatcctgccaataggagttttctgtcactttcccacagagccctggctactacatactcttgctcaatttcgccagtaattgcgtcaatgtgttcatatcaagtttgggaagaacatcttggaattggtcagacgtgaactgtggtaataatgggggcttgtttttttaagcagataattaaattcctttgcatttgatgattattctgggaagcagactagtcccataaaatgaaatggactctgccttgctgctaagtgtctgacttgagacatgctatcgagtttctcaaaatctcttccttgtgtaaaatgtggttgtcgatgattaccttacaggggtttttttaagactaaatgagatcgtgtacattaaatacaggcactcaggctgggcatggtggctcacgcctgtaatcctagcactttgggaggctgaggggagtggatcacttgaggttaggagtttgagaccagcctggccaatatggtgaaacaccatcccatctctacaaaaatacaaaaaagttagccaggggtggtggcatcgcagctactcaggaggccgaggcaggagaattgcttgaacctgggaggcagaggttgcagtgagtcaagattgtgccagtacactccagcctgggcgacgaagcaagactgtctaaaaaaaaaaaaaaaaaaaaatacgggcactcaatacaccgtataataataatatagtaataatatttgcttaggatctttaaaaagtttcattttttcagactcccacagaaatggctctgcacagcagagtgaagggggagagagactgagtctccaggccagaaaaaggccaggttttttgcttttgtttttagttgttgcctggatattgcacagaaagaaaaaataattagcaagttaaacaaaagtaccgcaaagttgattacattggtatttgagtatcacatcttctctcagaagcgtaagagacaaggtcgtgaccatacctctgcttagttttgttttgtaatggtgttgctagtgatcggcttgtcaccagttactggtgtttctaaatggactataattggctacttgaaaggacttcctgagaaagaacattttggaggacgaggagagagtgccttctctattttggctgctttcatgtgacatgcaagagaccatgacgtttaggctgctgctgaggcagccccagaaatgggggccgagaggtcttttcttcattttaatagggtctgtaggtttgggtggttaggtacagttctcagaatggaggttcctggctatgaggccttgagaaagctgaaagtctccttgggagtgtgtgggtggggggagtcgagcccatctgttcatgggcaggtgtcagccaaagcccttgcgggtggttttgaggttggtgggagaaagcatccgtggggtttagagttgtggccttttcactacttgcagttcctttccccgacttggctttactttctggtgtccaggggtctgggccagatgctgagattcctctcagctgacaggtgtgggttatgggcaaacccttccctggaggacataaggcaccggattggactgctgatgggttgctgttggagttgtcagggccttggaatagtcttcagatagacttgggttagtgtgacctggggcaggctgcaggtttggagccatagtaccccccgcccccacaccgggcaccctgctctgggctaatgtgaggcttgcaggagtgagtgatgcagtgggaaggggggcctttcctgaggattctacagctttctccagggaatcctcccaggtagtttaggcctgcaggtgctatgctatccttctttcctaaccctgtctcaggtcctcagcggggccatgcggcatccacttataaccctgcagcgaggccctcttttctggccacctgggtgtttgcctgctgagatgggaggaacagtggccttgggcttcttcccccgtcatgtttatctctgctcagattgggcagcagctcaatgggacttgaccagctgtggcactgccagtctgaagatgagtagggtgatggggggaggtgggcagtacctgaagctgaactggtgagagaggcaggctggcctgggggctcagctggggcctgggatggttggtacagtcccctcaggggggtaggggagtgagtgttagactgcttaagcctcagaggccgctcttgcccacctatgctttgaggagatcctcttcatttgttcaaagggaagactctgatctagagatgggcacttggaccagcaaacagcagctacaggtagccagggcacccgaggagcacttgctcatgagccggtttccctggtttttatgggggctgtcgctgagcgtctgccagggtttgtgtcctagcacttgctggtctttgctgggctctcagctctcaggtgtttctctaccagcacgtttccccctccctcatatgcacacatgtggacacaagcaggctgcccaggacagagtgtactttgaggcttgggaaaggactctctctcgcccttttggggatgagccttggaacctcatcaccttccggcttggggtggagcttcatcctgggggttgaagctttaggctcagataactagtcttgtaagccagttttgtcctgttgtttttttcgtggaaaataatgtattgacgtatacacagacattctttgtctaacagtctgagattgagaaataccctccatgactatttggtttgctttcatggtgaaacttggtcgctttcttagacacagcctatggcaataagagtgatccctggctgctgtaattcattccagactttgagcaaacacaaggcaccgcctccacctgcagtggagcctctgatgaaccaaatggaaactccttggggaatggggagtaagagccaaatgtgggattggacttaaactgcagcttcttagaactgtagcattccacgatgggattgtctagtgctcttcctggaggttactattcaatagttggctagtgcacaggttcaggggtgacctgatatgccctagcgtttcagaagatccctgcaaggtgtgtcttttggtccatctgaagggtcttgtatggtgatcttgtatggatatccgtgacggctaaggcatctgataacttcattccttcagttccagcagtgttcctgtattatgctgggcactagagctacaaagaagaaaacaaagtgcctcctcttcaggaactcttaatttaggcaggggaggcataattgaacagtgctgaggtcatctaggggaaccaaagtgtgtatttatccccttccctatcactcccctccctccttcatttcttcctttcttctttcagaaactccaagttcatatcaaaattctccagccctggttttatttggttgtgtgaaaattttcctctaatttctgaagctatgcattagttctgctgagtaatctttaacttgctgctttataatgattataatgagatatcactgggtattatggtctttgggtagcagcagggtagggatttccaggctgggactaagctaatttatgggttgggaattatggggcagttaatagcaaggcagtccaagctttccacagattccaccctagggaccatccagacttaaggaacagggccggcaggctcatcccctttgcactcagctgggctatgggtgtgtgtttgtgaaagaggtttattcagtagtcatacctgctgatttccctgctatctgtttacccagtgcctcctgtaccttgtttcttactctttgttctctgctcttactatgaagaagcagagactggaattctgcttgaacccacatctacctggaaattccagtttttcttgtccagtggagcagcaatccagttgttttaggacaaatggtctgcccttgaagcttaaatcctttgagggcctggcatggtgacagttttacatttggctttggtatagactggtgtggtccctgggcagtgaggtcactgtaaggccagccagccagaccctggctcctaggggaattaacaaggcatgggattagactcacagggtccctcctgtccctaaacttggtaggggttcctgggagccagactgcgattaagattgtagagacctgagacctgagttgtaggggcctctgtgttgatctgggccattgccgggtgagctgaggcggtcactagctcaaggagtgatctcaggatattgttctgtaagtcagagacctccaggttggagagtggggcttgggggtgggggacagggtttagtggggagctggttctgggtgaatgtggcctaaagggatttgtccttagaagacagaggggtgagtcacacactcagtgcttcaggttccactttgcggcttggcctcagcccgccccttccctgcacaaatgaaggccaggggctatataattggctgttgctgaattctttggcagtgattttaaagtctggtctgggtgtgttatgtagctgcttctctatccactccccacacccgctgcttctccagagcccctcacaaagcccaggcagagagagagagagagagagagagaatgacttgcctcacagagatgttggggatagggataggggtatgggtctttgcttttgccttttgaggggggataatctcttccttcattttaaaagtaaaaagtaatgcaggctcattgaaaataatttgaaaagttgaaagagatataaaagcacacccaaattcctatcacccaaaagaaacataccggcatatttcctactagtctttttcatgtttaagaatatagctgatatatttttttttctttttctttttgagacagggtttttgctctgtcacccaggctggagtgcagtgatcacggctcactgcagcctcgacctctcgggctaagcgattctcccacttcagtctcccgagttgctgggaccacaggtgcacaccgccatgcctgactaatttttgtattttttgtagagatggggttttgccatgttgcctaggctggtctcgaactccagagctcaagtgattcacctgccttggcctcccaaagcgctgggattataggtgtcagtcaccacacccagtgttatagctgttgtctttatagatgaacagatagattgacatagattcatgtagatagcctggtgttcagcatttttcatttaagattctgtcacagacttgaccctatacctttaaaaatcacaaaggcagtatcatagtctgtcagctgaatatgccataacttaaaaaaatcattcaactgttgctgaacacacacatatacatatatagtttttgttttttcttagtgatgtgtgatgcttgtgcagaaagctttatgtactttttggatggtttctgtaggagagctttctaaaaaaggaaaaaaagtgttgaatgttttttgagaagggctagattttcaagccagtcttacaaaaggatagactcattggaaattccagatttgcttagtgctggcagatgagtatcacttattgctgaacaatgtgtctagaattctgattaaaaaagaaactaggtccaggaagtgcctgggggcaggggcaaagggccaggctgcaggataggctcttaggatctggctgagcagaaatctgctgtgaacagaatcggtgggggtgatgctttctcagtaacttctccatttgtttctttagcagctaagtccctgtgctggacttctgtggactactgtggctctggggctgtggttgtgggtgaacaacagctagctaaaccagtgctgttgacatcattgagatgtgacgcacaggaaggtgggagcaagcttgcaaatcagattctgaaacatatagcacagctctcccacctccaggtggtcctgagatctagggaggagccatagtgagaaactttaggtttctaggaattctcttagggagaagctctcttagggagaggcagaacctggttctcagttggggctgattcaggtgggttagatcaataaagcctcaggccagtgtgccaggctattcccaaggagtatactttgaagttactccctttagaatgtcctcagtggagataaattctctctgaggagcagttttgtctgccggggtcatttggcacaaagcctggagtgctagggcgaggttgcactgagggaaggggcaggattatgtcagcagtgtgacggatacagtgtgaggtcaggctccttcctgccccaccacgggggcctagaggtcatggggagggtccctggcaggggattcaatcattgcttggccccatgacagagtatattctaaaaatgccttaagtttttttctttcaaagtttcttcctgttttgcataatggccttttgcctttgacatcctgaaaccgcagagctgtcattggtgttgcaggacactgccagcttgaaaaaaatcaacaacaaaaaaagaaacaggaaaggatgtggagttcagggtgcggcctagggaagctggtatttgcgttatgggattgtggggatgtggtattaaggtgttgggtagcgcctgacatttagaggagtactctgggcagagtccctgcctgcccaagaataggtagaattgagtcttcacaccaaagtcaggagagaccccctccccccaggaagagaatgaacagggactcatttcctcattcagcaaacttttattggtaactacactatatgaagtgtgagagatagacatgaacaagagaggcccccactcttgggcagtcccttagtagtagtagatagactctggcaatatggtgtggtcagagagaggaagcctgggtgctttgagggtactgaggaggtgcagggagccaaatgggtggtctgggccagggccagagtcagaatgaaggacctctcttccagacgttgattttagcatctctgtctctcagtatgtttgaacagtctcccttattggaagggcaggagtctactgctaaaagtaacctgcgatttcctctacttgctgtcatgtggaaagaatactaaagctgaaattccaaaagttgcacacctttaccagcagggcaggagaggaaaggaaatggaggcagagtgagctgaagatgataaaagaaagagaaggtggtgcagtttggactgttatggacagaggaagtctgagggtagctggactgagggatcaaagggaggcagttgaaagggaagagagctgcagagagggatttcttggtctgcagagggtaggagcaagccttgaaggctgctggagtgaggattccgagctctggtctttattctttttctaattcattacatcattttaggcaagtcctaactcctttggtctctgttgtctttctgaaatttgagtgggctgggcctgctggtctttagcctctgtctttctctacctcctagattccagtttggcgagtgggggggaaaacctggttgtatatgcaacgtgaaaggcctctggaattccttttgaagctcactacccatgaggcttctgctaaggatttcatcatgtctgtctaagcagacataaaaattttagcaggtggatgacccgtagaaatggcacaaggaatgtttctttctgtcacactgtggtatttgatttaagaaagttgttatcctctctgtgcctcagtgttctcacttgtaaaatggcaataacagtatccacctcatagatgttatgaaatacaggtagtagccacgaaagggcttaaaacagtgcctaacacagaataagttgtgaatatatgttatttattattggtagtataatgcttatttgtgaagattttggcttttgctttataggaccttttttttttttagttgaaaatacaatgttaccatgttaaatgttaaaaaaaattctacttaccattgtaacagaacatgctcccacttctgtaacagagcttgctattacttttcaaatgcatacatattccaatgcatatattccaatgcagttgtagagtgaaactgtttgcatgcagccatttttatccaacattatcttataaaatgttatgttgtttatgattatcctaattatcttttgttgctgtctagtatccttatagatattccattagcatacactattccaggtttcactatcgtagataatctagatatgaacatttttgtagtgtgtagctctttgcttcagttgaattactttcctgggataaattcctggggaagaatttctaggccagaggatatggtcatcttgacaatactgattcacattgctgcattgctttccaagaggtttggaatcattcacaggttctaaattggaaaatcctggcttttgaagtatgtggattctaagggcgatttggatctagctggagcctcacactgacacttccagccagtgtgtgtgtgtgtgtgtgtgtgtgtgtgtgtgtgtgtgtgtagttccctatgctggacaccgtgtgtgtgtgtgtgtgtgtgtgtgtgtgtgtgtgtgtagttccctatgctggacaccatgtggcctttctggacattagggttttcctgtgattgcctcagagcagttcctgttgaattcactctgtgtccacaaaaggagccttactgtggctctttcaacacccacctacctttgccaagttggtttacagaaagtaagaacattctttccttcttccttgatatgtggcgctaaacctatagcatggggcaggctctggctttaaaaacctgacttaaaaataatggtgttgatcaaaaagtttgtggatcagtttttggaaacactgcatgtagccatccatagaaacttatattctgttgggctagcctgggcgcctgatcatttaactcatgtggatgaacttctatgtaatagccctggtgtatgggatccagaaacagggccctaatgaagaaaggcttttaaattatgttggataaaaataagttgttacaatagcccaaagtctgcaaatatgaattgccagttctgtccttgtagtcatccaccatgtgcctgcatcttttgtagactcttgtagattcagaagcccactgaattgcataaatgatggaatgattttagacttagtgatttcagtgactaaaagtttacagatcctggccgggcacagtggctcacacccgtattcccagcactttgggaggccgaggtgggtggatcacctgaggtcaggagtttgagaccagcctggccaacatggtgaaaccttgtctctactaaaaatacaaaaattagccgggtgtggtggcatgcacctgttgtcccagctacttgggaggctgaggtgggagaatggcttgaacctgggaggcggaggttgcagtgagcccacatcaggccactgcactccagcctgggtgacagagtgagactctgtctccacctcccccgccccccgaaaaaaaaaaaagtttacagatccagcagatggggcatattcaatttgtgacagccactcccttcaccttatagctatgtcatatgtcttcttctcctttgactgcattctgcagcagtcagttgtgacttaatatggcactctgggcccactgaattaggtcagagctgctagtagtatattgttcctagagacctagggcaagattttcttactacataaaatgagggagataatttcttacctcaagatgttggtaagaggagtgaatgaggttagttatatggtaatatcagtactctgaatgtcttttgatcaatgcctaactcatcttcttgggcacaaaaggcatacagtcagcacccttaggccacatataaaattcctccaaatgcaggttttcatctgccttggggcagagtcaagagaaagaagaggaagaggcgtgaggctctgaccacaacttagggacagaatatagcccaaagcgagtaccccaggccacaaggagaaggccgctatcttgttgaatccacagcactggaaacttggagtgtgtgttcccctgtgtcagttacactggaattttatggctgctcacattcttcccttcaggtggacgttgttcatcagtatcctgggcaagaggccatcataaaccacagacagctgagtgattaggaagaggagctgaagagggagcattagatgtttgattgagtcttaggtgagaaagtatatcattaaaacaaaaagatagatgtaggcgggctcagtcttgtgtgcctggtgtgttggtagaaaaactaaagcacaagcctgtagataacctgctttattctacctcggggctggtgttggaatccaggatgccagaccctaaagtccagctctctttccaacctactgaataatccgagagaaatcatgttctctctctgggcctcagtttgcccatgtataaaatgagatgaaggattggctgggatgctctccagagtctcttcctgcctggagttctgacgtagccatgtactcctgctcagcatcgctaaatggctttgtggtaggaccattgagtgctgcctccattagggccagctatgtaatgctggggtggctgtcactgggccctaagagccaggattggtcttactggagaaatccacatccacctaaacttaagacccaggggtgtccaatcttttggcttccccaggccacactggaagaagaattgtcttggaccgcatataaaatacactaattatagccgatgaggttaaaaaaaaaaaactcaatattttaagagagttcatgaatttgtgttgagctgcattcaaagccatcctggccgcatgtggcccatgggccatcggttggacatgcttgctttagacctcccagcaattctagtctctaaacaggaaatcaaaagtcaagatgaatagataagttggtcagtgtgaaaaagtaattggtgggagccactgtagatgcagggttctaggctccatcaacaaccacctacatcactgaacaaaagataatgcttgttcagcacttattacatgccaaccatggtaaaaatacttcagatgcattgttttcatgaactctcacagcagctctttttcttgcctaaatgccccgttagaacctccagtacaatgttaaatagatatgctaagagacaacatatgtgtcttgttagggggaaaatatccagtctttgactattaagaatggtgttagcagtgggtttttcctaggtgccctttatcaggttgaggaagttcctttctattcctggtttgttgagtatttttatcatgaaaaggtgatgggttttgtcaaatgcttttctgtgtctgttgagatgatcatgtttttttgtcatttattctattgatatggtatattatacattgatttttcagatattaatcttgcatacctgggataaatcccacttggtcatggtgtataattctttttatttgttgctggattgagtttgctagtattttgttgatttgtattcataacagatagtggtctgtagtctttccctccctccctccctccctccctccctcccttccttccttcctctctctctctctctctcccctcccctcccttcttttcccctcctctcccctccccttccctttcttctctttcatagttgtttaccactgtcagaaaaggtctgttcgttttctttcgtcgtgagatctttgtttggttttggtatcagggtaatactgcctcaaaaaatgagtagggaagtgttccttcctcttctgtattttgagagagtttgtggtcggtttttattaattcttctttaaatatctggtagcgttcaccagtaaagccatctgggcctgatgttttctttgtggaaaactttttgattcctaattcagtttctggttataggtctattcagaccttctattttttcttaagtcagttttgatagtttgtgtcttccaaggagtttgcttcatctaagtcatctaatttgttggcatacatttcatagtgattccttatgatcctttttatttccgttaaagttggtgtagggatagtccctctttcattactgattataataatttgaattttctttttttcttagtcttgccaaaagcttgtcatttttattgatcttttcagaggaccaactttgagttcattatttgttctctttgttcttatttttctgcttcattaacttctctaatctttattctttcattctgcttgcttttggttaagtttgctttttctggtgtcttaaggtagaaggttaggttactgatttgagatttaaagatcatgctctttaaacgttttgatagatactgtcagtttgccctctggctttttctcattaacagtgtataggagtgcttattcctcacactcataccagccctgggtgttactaacctttatatatttgccagtatcatattcagacatagtatcttgttttaatatgtttctctgattactgatgaagttaagcaaattttcacgtgtttattggccatctgtctttcttttttcatcctttctttcaagatgggagtctttgccatgttgcccaggctggactcgaactcctgggctcaaatgatcttcctgcctcagcctcctgagtagctgggactataggcgtgagccaccatggctggcttgcccatttgtatttcttatgtgagtattttttctttttttttgaagtggagtctcactccatcccccagagtggagtgcagttgtccgatcttggctcactgcaaccaccgcctcccaggttcaagtgattctcacaccttagcctcccaagtatctgggactataggtgtgtgccaccacacctggctaatatttgtatttttagcagagatggggtttcaccatgttggccaggctggtttcaaactggcctcaagtgattcacctgcctcggcctcccaaagtgctgggattacaggtgtgagccactgtgcccagctgactttttttttcttttttttaacccttttttttttttaccctttttttggcccatttttttttaccctttttcttttaacccatttttctattagttttaaaaatatgtttgcaggagctttttatattgtggatttttcttgtttattacatatcatttgtaaatatggtctctccatctgtcactcttctttatctctggtttctttagctatgtagaagttgttatgttatgttatgttatgttatgttatgttatgttatgttatgttatgttatgttattttttggagagggagtcttgctctgtcgcccaggctggagtgcagtggtgaaatctcggctcactgcaacctctgcctcctgggttcaagcgattctcctgcctcagcttcccgagaagctgtgattacaggcacccgccaccacacccagctaatttttgtgttttagtagagacggggtttcactatgtaggtcaagctgatctcaaactcctgatctcaaatgatcctcccaaagtgctggggttacaggcgtgagccactgcactcggccagaagttttgaatttttatgtgtttaaatctatgttttcctttatgacttcaggttgctttcatacttaagcaggtcttcaccatcccaaaatgataaaatttttctcctgagttttcttctaagttggttctttagaagccaccaacttggcttcgacagcaaaagatgaacagaatttctgttcaactctcatgctgcaagaagctttatgtaatactccagggaccctttaaggtcccagagttttcctccaaatctatcagtgattctagtggctaagagtagaaatgtgaaaatttagccatgtgtgctgatagagctgtagtaatttgtaagctctgaagttctaaggagtcaggggagaagggaaagtaacatttattgaacatctattagctcaataagaacatgcgataagtatgtatatgtattatttcacttacatctgaaaggaaggcataattatccccactccttagagaaggaaattggagctggctacatttaaagtagtcctgacaccagagagatattgccaggagtacttggctggctgagtgcccagatggcccataggagtagtgggccctccacagtccaaggtctggttctaggtggagagagaaggatgtgctcgtagtcagcaccgcagctccagaaaatctgctggggctccaaaactgattagaggggcagctgactcagtaataaaactcccaggagacttacttacatactggaatgcaaagttgcagctttactgggaagattagaactgttattgagtagcttagaaatctctggctgaattcactgcaagggaagccgcaggataagctaactgctggtgagtcagcagtcagagcagggaagtgaatttaacattagatgggtcagtctctcgtggctgatgaattcatccccacaatactgtacacctgccttagggacctttgtctggactaggggttggggtccccctcctttgtacagccctggaaggacacatccagctccatccgccatctctcccttacttatttccttccttccttccttctttccatccagccatcaagcttcctttcatggccaataatcatcattggggtctactcatggactctcttgcctcatgtatttgttttattttgtcctcattcccacttctatttcccaggtatatcacaggcaactattctaacgtatttatagtttgtgtatctgtttttgctcttgccaaaatggaagccactgctttatacatagatgtattcttaactttaaaaaaaatttttttagattaacctacaataaaattggctttttggcatatagtctataaattttaacacatacatatttttgtgtatctaccaccacaatcaggatacagaacagttccatcaccccaaaaaaatccctcttgtagtcacattctcctcccacccttaatcccaggcaaccactgatctattcttcattactattgttttgtctttttgaggatgtcacataaatggagtcacacagtatatatacatttttttaaacatatgtaaatggcattttatagctcattttgattatatgtttttcatccagttctgttttttttttttatttttaaaaagtttgacataacttcagacttacagaaaagttgttagactaatacaaagaattcctggatatcctttggagtccctaaatgttaacattttactatatttactttttccttctctctctctctctctctcgctctgtgtgtgtgtgtgtgtgtgtgtgtgtgtgtgtatctacctgtagatagatagatattaatataattttagatagatgtatctagatctctctctctcatatatatgtgtgtgtgtatatatctatatctatatctatatatatctccttttacccttaaatattcagtgtatatttcctaacaacaaggtgatttaaaaatatatatataaacatagtataattaacaatcaggacatcaacattgaaacatttctgctatgtcatctacaggccttaggaagactttgtcaggtgccccaataatagccttgatggtagaagaaaaccatgtgttgtattcagttgtcatgtctcttagtgtcttgtaatctgaaataattcccaagccctttggatttcatgacagtgacattgttgaagagtacaggccagttattttgtagaaggtctctcagtttaggtctgtctgatgtttcctcctgatcagattcaggttattcacttttgacaggaataccactgaaatgatgctgagttcttctcagtgtaacgagatctagagacacacactgtcagtttgttccttattggcagtgtgaaccttgaggatttcattgtagtggcatttggcattactccattatagttactattttaccattttaaattaaaactatctggccgggcgtagtagctcatgtctgtaatcccagcactttaggaggctgaggcgggcaaattgcttgaggtcagaagtttgaaaccatcctagccaacataacatggtgaaacgccatctctataaaaaatacaaaaaattagcctggcgtggtggcgcatttgtagttccagctactcaggaggctgaggcacaaggcttgcttgagcctgggaggcggaggttgcagtgagctgaaatcacgccactgcactctagccagggtgacagagtgagactctgtctcaaaaaaaaaaagtaaataaataaaaaaaatttttaagtatcttatgggcatatacttgtcctgttactcctcaaactttcatccacttttttttttttaaattttttttcttacctttcatcgttttcttgatatccactgggttttagcatctacaaatgattcttgcctgaatcagttattatggtagttgatggttttctaattccattattccttctatgtttgttaattttggcattcttctataaggaagagcttaccctttttccctattaattaattcatatattaatgcagacctatgcattcttacttcattaaatcataatcctttactatcattatgtattctgatgttcagactatcccagatttagccaataagatccccttcaggggaatggtctttgggattcctctttagaggttcctggttcctgttttcttttgacatatcctattactctttgagcatttttttttttttttttacttttaggcacagcaagaagttccatggtcctcttgttctttccccaactcagccctagagtcagtcacttctccaatgagctctagttccttttagtagagaatcataattagaaaacaagaatcagtgccaagtgtgcacctttgtttttaaggtccatccacgttgccgtgtatatgtccagcatgttgattctaactgctgaataatacctcatgattgtcatccatcccagtgtttctttttcccttctgtaatgagggactcctggactgcctccagcattaccttcacaaatattgctgtgaggaaaatccttaaacgtttcctttatgggcaacgtgtgagcatgtttatgttgattcaggggtgccagacacagctccagaatggctgcctcagtttacatttccaccagcagagcatgacaggctctgtgtctccgtgaataatcagcattaaccagcttcctattttttgccaaactaatagatgtgctagggtaactctttgttttaacttgtttttctctgattaccaatgagctggagcatttcttcatatgcctgatggtctttgggattcctcttaggtaaattgcttattcattataatcctttgcctgtttttcactggagttcttatatttttcttgaagatatgcaggaattccttatacatcctagatattaatcccttcctggtctcagacattgcagatatcttctgaatctgttatttacttatttatttacaattttttttttaagagttggggttttgctctgtcacccagactggagtgcagtggtatgatcatgactcattgtggcctcgcaatcctgggcttaagcgatcctcccacctcagcctcctgagtagttgggactacaggtatgcaccaccagacttggctaattttattttattttttagagatgggagtcttaatatgttgctcaggccaatcttgaactcctggcctcaagcaatctttccacctcagcctcctgcatctattatatatatgttcactttgctcatgctgtattttgttgcaacataaaactatttttcccattgttttgtgcagtctctcaccagcactcttctttttctgtaactgtgttaatgccctttgttcttccatatgttaggtatgctggtatagttgaactctgctgactctcctcagtaaacagtctctttttatgacaccttatcctctactgaattctctctatcaagaatgacttggccgggcatgggggctcatgcctgtaatcccagcattctgggaggccgaggtgggcagatcacccgaggtcagaagttcaagaccagcccggccaacacggtgaaaccctgtctctatgaaaatacaaaaatcagctgggcgtggtggcaggtgcctgtaatcccagctacttgggaggctgaggcgggagaatcacttgaacctgagggggaggttgcagtaagccgggatggcacattgcactccagactgggtgatggagaaactccatctcagggggaaaaaaaaaaaaaaaaaagaatgacttgtcttcctcttagagtgtgaggtctacatacaaatattattcttgtattcagcaaatgtatgtcataggcctagtgtgtgttaggaactgtgctgtcaccaacaaagtttagagaggttataaaacttgactgtagctttttagaggtggaggagtgatttgaaacctaggctgtaattccttcctcctgtgattccttcctactgtgttgccttcccttgaaaattgcatttgggggccaggtgtggtggctctcgcctgtaatcccagcactttgggaggctgaggcgggtggatcacctgaggtcaggagttcaagaccagcctggccaacatggcgaaaccccgtctttactaaaaatacaaaaattagctggatgtggtgtgtggtgacatgcacctatattcccaggtactcagtaggctgaggcaagagaatcacttgaacccaggaggcagaggctgcagtgagctgaaattgcaccactgcactccagcctgagtgacagagtgagactctgtctcaaaaaaaaaaaaagaaaagaaagaaaattgcatttagttcctgtagactgtgtgtcaaatgtctaaatctcttctaacaaatggcctaaggaggtgcaaagcgaagcatcctcaccagcatcctgacttggcagtgaggcatgggaccctggagggagtagtggtaagtgtgactctggagttcttcctgggctacttgtcagtgactggctccagattgagaggagagcccagaggacacaggtggctgccccagcctggaggtgaaagtcttaaaataaaatgccagatgcctagaccattctaatcctttctgagaagctgaaatcatcccttctggaagcgctctagttctaaaaggacagatatacagcaagatcttcctggggctaatatggagtttataggcaagtaggcctcagaacctttccctggtagtgatatctgtgggcaggcacagtttccacactttccagaaattccagcggaaggagtgagaaggaggaatctgcccttgagtgaggaccaaagaaagcagaaattcctcttgggaatttttcctccagagaccaaacactacttgggagcttgtttactgggctttaaaagcttgtgacccccagtcactctttcttgaccccaaggctttgcatttctgtggcttccccactggacagaagtggaactgtcatgctgcctgttctggggtctcccagaggtttccccatgtcctctccttgcttctactgccccacagaattggggatctgtgaccacatatggtatagaattaatgcttgagaatggtttagttcagtgatgtcaaataagattcacttttatgccacctccatcagttgaaggcccccctggcccctaaattggaaaagattctgagacagaatccccgtgggtacagcgcagggacagtaaaggcacgtgtgctgtgatttgctatccactgtgtggatgcatccaggaatatcagaaccctggaagattatttaaggggaagttaggacagcttttttgccaatccaagggtgttcttgaggaagtctgtcttcctgtatggccttcagtttctttcctgtgtaaccatggggccaacacataattcccacagctctattggcccttgtctgccaggattctctagggtctggttcgaggtggatcctggccctttgaggtggcagaatctgatcatggtgctgtttccttagatttaggccttgatacccttggcgagagcatcctgggctgagtgaccacctgaggtttttctggtgattttgtgacccatgtaaaactttgagctttgggattattctctcaaggaaatagtgacatttggtgaagagcctgtttggtgtggctatgtgaggcttagccaagaaaatgcaccatttttattaggaggttaggccatccgttgccacaaagtgtcagatgctaggcctagagcctggagaaaacttattttaaaattgatggggtgctggaggggttggggggtggtggctgtagctcatgaatcaggtgctaaacctagaaacaaaaggcctcatgtggcagactgtttctgagcacagatgaatggatgagcaactggcgcaactttgcccagttggtccagcttcccacttggccacctaggcttgctgtgaagacctcgtctggcagaaatgagagtgtttttgccccatcttgatcttaactgtaatttaagactaaaatcttagattctaaaacatcaaaggcaagatggctcccagctctgtgagctcagcttctcacctcttagttgaacaagtgcagtgtgggtcaatacatgattgctgctcttgctgccaggaactgtcccagcatagaaaggaatgggacacaatccctgccgtcaagattctaagggaggaagcaggcaggtcgactggtgcctcatctctgcagggctccagccaaggtttgtgaaggattttgcaggcatatggagtggggactgattgatcccgagaggggactggggaaagctctgaagaggggatgacatttggtttgaactccaaaaaatggttgctttacctgtttcctgaagtttttgaggtggcttataagaacatataccataaaaaggaccaatataaatttaaaatcagaaaaagagaaaatgggctgggcatggtggctcatgcctgtaatcccagcactttgggaggccaaggtgggtggatcgtgaggtcaggagatcgagaccatcctgcctggccaacatggtgaaaccccggctctactaaaaatacaaaaaattagctgggtgtggtggcacatgcctgtagtcccacctacttgggaggctgaggcaggagaatcgcttgaaacctgggaggcggaggttgcagtgagctgagatcgcaccactgcactccagcctgggcgacagagtgagactcctcctcaaaaataaataaataaagagaaaatggaacttagaaaattaagaggaagagtgaaaaggtagatatttagtcaggcacagtggctcatgcctgtaatcccaacactttgggaggccaagacaggaaaatctcttgagaccaggagcttgagacttgcctggcaacatctcaggtgagaccttatctctacaaaaaatttaaaaattagctgagctgtgtggctcgtgactgtgatcccagctactcaggaggccgagaccacagcccaggaggatcgcttgggcccagcagtttgaggctgcagtgagctggcaccactgcaattcagcctgggctacagagcaagacccagtttaaaaaaaaaaaaaaaagatattcaaaccatgggtcccaacgtagttattatatttgaccatttgcaaaagctgaaagcaaaacatgttacacattttcagagaggaaaatacacagtagttcctgagtgtaagttgtttttcttgacctcattcttaaattgcttcatgagggtgggagggaagtggtagttaataagtgaacctgtaaaccagcgtttctcaaaatgtagtccagggaattgcatcaaaattgcagttacctacagtgcttgttaaaatgcagattcctgggcccctgccccaggcttatcaaatcaatctggtgagtaggactcaagaacctgtaaattcacatacttctgcagatgattcttcttgcactgcacagcatgaaagcctctgcaatagacagaaagctaccagcattgcgaaagcaacttgagtgcttggcctttgaaggttgagtgggactttaatgagggagagagtaaggcatgagaaatggcagttccactgaggtcagtcagtggttcattgctgacgaagtcacttttaagtcatgttttagaagaactaccaagtgtggcaggtcaggcatgtggcaggactgtttctgagcacagatgaatggatgagcacctggccccactgtgcccagttggtctagcttcccacttggccacctacggtctgctgtgtggaccttgtctggcagtctcctttaatttattttttattatttttttctttttgagatggagtcttgctttgttgcccaggctagagtgcagtggcatgatctcggctcactgcagcctccacttcccaggttccagcgattctcctgcctcagcctcccaggtagctgggatcacaggcaagtgccaccacgcccagctaatttttgtatttttaatagagacatggttttaccatgttggccaggctggtctcgaactcctgacctcaggtgatccacccatctcagcctcccaaaatgctggaattacaggtgtgagccaccgcacctggcctattttttttcagcaaattctttgtttttctctctgttcccaaatgcagggtactgagaccacagatgtattctgtttcctgttgaaaaaatgtttctcacttagctgggtgtggtagcatgcactgcagtcccacgggaggctgaggcgagaggattgcttgagcccaggagttcgataatcatgccattgcactctggtctgggtaacagagcgagaaactgtctcttaaaaaaaagaaaaagaaaaagaggtcctagggaaagaaacaaatagtggcttggatggtgagttggtggaaagaacagtgggtgttgggggtgttgaacttgtgtttgtgtgtggtgtacccaagacatatcatgtcagcattaagaatagactattcctgttttctggtcactgagttgtatgttttgacatccttattttggaagatacttccttactaggaatgggatagggagggggtcacctttcccatctgtgggtcatattttaaaatatttattgttcaagtttaaagatataaccaaaggtataaagaaaaataccacaaacatctgatttaagaaacaaaccagccgagcgcggtggctcgtgcctgtaatcccagcactgtgggaggccgaggcaggcagatcatgaggtcaagagatcgagaccatcctggccaacatggtgaaaccccgtctctactgaaaatacaaaaattaactggtcatggtggtgtgtgcctgtagtcccagctactcgggaggctgtggcaggagaatcgcttgaacccaggaggcggaggttgtagtgagccaagattgtgccactgcattctagcctggcgacagagtgagactccgtctcaaaaagaaaaaaaaaagaaagaaatcatttcctacaccttcgaagccttcatgagttagattttgaaacagtgcaaaatgcttcacgtgagaatcgagagtcccttctggtggctctccatcccctgctcttctgtcaggttttcttgtaggtttatggaaacctttgttacttgtgcaggtggcagagaagcagagaggatagctgcgcgccacccacacagctaggatttattggcgtactcccatgtgcatggcagccaagtggacacaactctgtgatgaatcctcccaagagaactgaggggccctgatggaggagctgcttctttgcaaagctttccttgactctcttcctgtcccctagttgattccccttctgtgctagttttagcttgttgtttgttacctgtcacacttagcagtactgttggctttgctggtctccttgactactgggggtaaagaccttttgttgttgttgttgagacagagtcttgctctgtcgcccaggctggagtgcaatggcgtgatttcggctcactgcaaccttcacctcccaggttcaagagattctcctgcctcagcctcctaagtagctgggattacagctacaccacacccggttaatttttgtatttttaatagagatggggtttagtagagatggggtttcaccatgttggccaggctggtctcaagcccctgacctcaaggtgacctgcctgtctcagcctcccaaagtgctgggattacagacatgagccaccatgcccagcctcaaagacctcttctttacttgctcaccctgccgcccactcccctaccaacccctgcatgccctataccacctggcacatgatacatactaactgggtacatgtttgaatatgaatggatgtggtgctgtgaatgcttaggggaagtgggtgaaatgcttaagaaccaaccttgagtggtctgggaaggcttcctgggagggtggtgtttgagctaaggccaggcagctgttagatttgttagactgaagcccttgcagacttagagagcttgtgctcttcccagaatgacgggtgagccacgtacagtaaatggtgcttctcatttctagcccaaggggcctcaaggggcaccgtgatttcacgagaatgctgcaagcaaatcttttctcaagctggggaatttggtggtaatgcctggctcagcttgcggtgcgcacctggcctttggaagattggtacagagagaagcggcccatccacatgagcctgtggaacagcactggtgggggagctgatttgtgaagaggggctgtgcagtgtactgtcaggtctgagacccaggaagaaattccagtatcccagctctcagaatcacagagttctaggcactgcctagttccacgtgttcccaaatgtttcctgaatacttggatttcctgtccagagaattttcaaaacaaacttagaggcctgacccatggctgccaaggaaggattttttttttaaattaaattttaaaaatcagtccagcatgaaaatctatgatgatttcataagagaaaggacattttaatattcaaagagtaagaagcacttaatcttggaagaaagggcattcctatactttgattacctttagtttaattaaaaaacacctacatggtctttacttctgtgatttcattcctgggctagtgaaacattgtcacaataaagcatcaggccaacgcttctttcgacccactggccaatcagttgacaaacagtgactagatgtttcagcctattttgctgaggctaaaggattgaactagtgcttcagccagcatgaaaaccagtcaggagtccgtgctggtgttggcttagattagcagggcctttgatggaggggcatgtatgtgtttgggtttgctgtgccaggcaggggagcagtggaatttgtctgaattgagctcacacattgaagttattgagcgacttacatgcaaggccatgacctggactcccagccgagaggcccacgtggcggggcttgagctgggggagccgaggacagcttacatctgctcatctgcttacgtaaccctgcctcccagcttccagagccaagaaaacacacaagccagcccagcggggccgagagcctgtggtagcacacgccatgcgccgcacagcaagggcgccttggctcggcttgaggcctgtcatgaagccctcagccctctgcctcctcccagagcttctccccaccaccccaggcagtggctctgaaacctggtcgcaggtctgcatgattctgaacagaggtagtcgttgccttcctggagtctgagctctctggagtttctcactgggacagagccaggtgtgtagcagagcatggtccctgcagtatggcaggaggtgtgcagggcattcaggaggcctcctggctggcactcgacccaattagtcattcaacgccaggtctggggctgctgtctgttgtctcaaaggtgtgagctgcaagatccttagagttgtggagaaaaaattgccagattggcaagaagggcaggattgggggtcaaggtgtctcagtgtgttggaagcatgatgggggttgtgcaaggggcacagcgagttcagaagggagcaggagagtgagaagaggctgttcagtgataaagctctgcacagagccattggaggagcaagctccttgaccatccttaaaccagggtaattttcatttaggttctgccacacgctcagcagggaactcctggaaggcaggatttgtcttgtccatcctccctccctacctcaacccactcctccttgggctggcacacagtaggtacccagaaagtatcaattgaaacaaattgaaagtggtcttgatacatatcacagggcaagtttgcagttaacagacatttcagagtaaagactctctggcttggtgctcgatcggcttctgtgggttgtcagcatgctgtggacagccccggcatgggagcgagtgggcgtgtgtgtgtgtgtatgtgagggtgagagagcgttagtgtgtgtgttggggttggggagagaggagggggaatagaagatggaccacccgggtatcagcttctgccctggggagatggtggtgtcagttgctgagggaatcctgagaagcaggtctggctgtaggtggtgatggtggtggggttgcatgagaatccatttggggcaggttgaatttgaggtgcccatgacatatggctagccatgttctgttggctgtgaggtcaggagagagacatgagatggaaacagaggtttgggaactgtcatgtgcttaaaccaaagacctgggtatagggagagtgagaagagaagggggcaaagatggacatccaagaaagaagctgagaaagcctaggaatttgaggtaagaggagacgtaggtaaatgtgacgcttggtgatcaaggcttctttccacctctcctatgctggacactcacgtctcctgtctgcttggaaattcatgctgagggcagggaaggtgggagcaaggatttgtctaaagatcttgctttggatccctgcactcctcctggtttaccaagtgtcactggacacgtcagggcgttctgagaccttagagagcatccagtcctgtccctgcagtttacaaatgaggaaaccagtaccctgagagtggctgtactatccactctcaggataccaaagatcatctggaaagtcactggtggagctggaccggggcccaggcatctcttctcctgtccggggctcttgacttcaggaccacctttctgaaacccatgatggggcaacaccaggacactttccagcctgcaggtgtctgtcccgcggaagcgagccaggccacgtgtgaattcctgttttctgggtgggtttcagaaggtacgagcaagtcggcagggtgacagcccaggtgcttcttgggttccccaaaacgcggttatgtttagcagcatcctcagaaccaaaggtggggtgggggctgcagatgttgtgggggccctctgaagtgaaaagagccctgtgacagatcttttcttcatgtttttcacaagttcactgtgcagcagggcccccccagtagcctttgcccagggttgggtgttgggcagcccaggcctggctgaccttgtggggaagggtgtgaatggtgggaatccccgagggccctctttgcccgaaagccctaagccttgacatcagatgcccatcagatggtccatcggagccctactacccagcttgcccagtgagaatcatctgggctccttgttaggtagccatttaggtccttcccaaaatccacagactctctaagggaagggcccgagatgctgtacttgtactaacttcctcaagcaattcttgtgataggtttgggaaaaacttgtccagggtgaccactgactgagtcctggtcttctctgaagagcacagtgcctgctcactttagggcaccctgggaggtgggagctggctcagcaggcagtcttataagggactgagcttcaaggcctctgtccctccaggagggaggtgcatgaccagagagggaggcctgaggatcttcttccctgccccagagggtctgctgcctgagctctgtgatagcgcagagagtaaaaggatcaagcttgattgaggcctatctctcaatgcgaaagtttgctagttaagaggagagtgggaagggcatttctggcaaagagaaaagtgtggacaggcatggcttaagggatggggagggagacagacagagctgagggtgaagggccttttgctcagctgtgggccttggccttcccttgtgcagggacacacagccttagagccactggaggttttagtgggaaagtaatatggtcggggctgtatctcagaagaaaacaaactaatgggaacaggtcctgtgatggtggacctgggtcagctacggagggagggaagatgtgagatgtgtactggggaagggggtggaagtggcagctatctggtgagaggaagcaggcccacagctttttttctcaagctgttgaattcagaagggcgagtgattccgggagtagggggtgcttggagagccacgcgttattgataaacagggcaggctgaagcctgctcactggccctgggcgggttctcaccagcatgtttcaggttttgatctgtgcttgtggttggtgttcctacctgttctctaggttccttcctttgttcttgtggctcatttgcttcacaggtgaagctggttacactagagtaacagttcccaaagtgtgttccctggaaaaatggttctgtagccaaataagcttgggaaatggtgggttaaatataacgaagggggtttttcgactgcacaacttctcagagcctttggtgtgtgtcgtgactttgcagaagcaggatttaatacgcagcattcccgttcttatttgaccacgagacatgtttttccattaagcatcttgctgggtctgatgttttctggaacccattttgaggcggtctggtctgcagagagtatggggagcctgggttcaagtcttggctcttgactctcagcagagccttgattccctgtgttgcctggactgcaccacgtgtaccacatacccggtatgtgacgttttcctcatccctcttcccacctgccgttacctcacaatccacaatctgcacctcatccatttttcttctgaggcaagcactctcttactaacttacttatctcatctgcatccatgttcttctaggccagaaacttgggagtcatccctccctctttgttacttcttcttcctctttgttactttatcccctctgttactaaacattcttctgtgtttccagctatttcttttattttccctcggtctcctttggggtttctttgcctccatctctcccagaccttggttcaccttccatcgagtcccttcctgggacatgggcactcatgccactcctgctaccttccacttcgaagctaactccctccacactgacgtccccaacatgcatgcatacacacacacacacacacacacacatacacacacacacacacacacttccccagttaggctagaatcagagagatgatgtcagccatttgtccaaggccacgcagctgggaggtcacagagctaagtctcaacctcaggggttttgagaaattgccttctcatccgtgatcactgatttctacaacagcctgtcaggaagtctgggtagaaattacttccattttacagtggagtcagagcggggagggtcctgggcaggcgagtgcttcacagagtgaccaaccatctaggtttgccccacactgaagggggtttctggggatggttggtcaccctaatgctggatgtggtgcctgatgctgggcaggagggccctctccgtggccacgttgcctcccaggaggagacatttcctctgcagctgcagctgcagcctggccatctgatgcagcctgtggagcggtggcgagtcctgtggcctgctaacttctccctccctccacctctctagtgggccccatgctgattgagtttaacatgcctgtggacctggagctcgtggcaaagcagaacccaaatgtgaagatgggcggccgctatgcccccagggactgcgtctctcctcacaaggtggccatcatcattccattccgcaaccggcaggagcacctcaagtactggctatattatttgcacccagtcctgcagcgccagcagctggactatggcatctatgttatcaaccaggtgaggcctgggaaggtggaatgagagagggtgtgtgtgcatgcagatgtgtatcagatgtgtgtgtaatgagggcaggggaaggggagtgatttcacagacacctggcacttacagcgaggaaccagccccccagccaccaccagtgcagatgaggtaaacgccaaacagtgtgcttgcctattgctgtcaactctatagccaagggaaatgctggagtgttttcgttgttctgtttttgttttctggaagtagccttccagcaagattgggaaaaaagacaaccctaattattccaaagtacacactgattattccctggctttgtgtagctgtgtattttccttttaaaaataaaaccaccatttagatgtcagacttttaggtaacttcaaagtttatccagtcagtcagagtgtgtctcctggggcacctggagacagtgcccttagttcaggtcacatgcctacatgccagcccctggtgaaatatctggagaagtctgattcgtgggccatctgagagttatgtggactgggccgagtctgagaaaaagtttctcactgctcgtctgatccatatgtgttgggctttagccctgcttaggaaagtaatgctaaggataggtcaactttcatcaccatggcatggagaatcagattgatctaagaggcatctttattgaaataaatttttcagtttatttgaggagcattattttcccaagagtataactttgatatttcaagattacccctaacacttaaattcatgtttttagactataacctcctaggtgcaatgacacatctaacttatctaagcacccagtttcattgaaattcatttgaagagtctgagtacgcccatttctacaaggcccaatgtccatttcatttcgagataaactctgctttaggtaggaggattgttggcagtttacggcttccatcaaggtcaaggaactctgtgcaccttccctatgaccccaggggaagcactcgaggactgctgtggcattgtgctgcatcacttgctgcagggagattctgaagaagtgtaaggtctcagtcctgccctgtcccgaagcctccaacccacttctggcaagtgggaccttcccagggaacaatttgttaacagacccaaatatcctgtgattggatggtggctgccaaatgctttggaagctcagaggaaggagagagagcaatggcttggaagaaccaggatataaactaggttctaaagtctgcagggagatgggcttctcagctggggccagtgagcagggaccttaaggcagaaaggagccttgcatgttcctggaaattgagatgcccactggggtaggaaagcaccagaagctctgggaccaggtgtcagagttaagcctgtgaggcaggagagagcagaacaagccctgttacaaggaaactgaagcaggagagcaggtggtgggcaaaccccttgaggctgtttgaattcttcggccaagtgaggtacagaccagggccctatgaacacctgcaagcaagacagccacgcagttgtgggtcaccttggaagaatattggagaatgcaagagagaacaggtaaatgtcctgcaaaatgcgggtcactttaacccaacacatattcatttaagaaaagctctgtgattgagaaacatttgtctgatgccagttagcacataccaatgacggcaagattcaggagcctgttattaaagcagtggcagcgagcacctggaagaggcggccaccatcaccaggagccagcagggatgactaataagccgtgccagctgcatctcgtttctctcttgacagttgctatgccagtagatgagggatgtactgtggatacaatgctgtcatatcttattcagcagggcatctgatagcatcccacaaatctgcctgagtagaagacagacagctgtggtctgggtgccatataggtaggttaaaatatatatttgggcctaggcgcagtggctcatgcctgtaatcccagcactttgggaggccaaggcaggcggatcacttgaagtcaggagttcaagaccagcctggccaacatggcgaaaccccgtctctactaaaaatacaaaaattagctggacatagtggtgggcggctgtaatcccagctactcgggaggctgaggcaggagaatctcttgaacccaggaggcagaggttgcagtgagccgagatcatgccactgcactccagcctgggcaacagagtgagactctgtctcaaaaaaataaaataaataaataaataaataaaatatatacttgggtaaagaggataaaagagttagcgatgatgctgaatttttgaactgaggtggctgttttcaaggaagactggagggtgggatgctacgtctagatatgttgcagtttaggtgaatgtgagacttccctgttttgaagtcaaatattggaccagtaaaatctagccatcagcttaaattcctatgatacaatttacatactccccaggctcaacacagtagatttctgaatgtcctctgccagctacatgctcctgcccacctcaatccgagtagatggaacaactaaccaagccagctcagaccggtggcacagctgtgctggctaacactgggcaccacctaagagagtgcttctccaaaagtgtgcttccccaaatggagcgaaatacgcttgaggaatgttgggttgaaccatgtaaagcaggtctcattcccgcagagcctttggtaccccggtgtacactgtaaccccagaagtgtttcctgagcttgcctgacgagacaacttttccaagaaccgtctcaagtgatgagtgttttgtgagtcacactttggggaaagcgggcctaagttagcatctcctcccagctgcctccctgctttccctggaacactaggaactgcccgtcctccctccctccctcctcttcccacttcacaacttagcatcaggaatattttagttttggtttttcaaacatatatacctccttttttcttatcttgtcaatatcatcttttttttttctttgcttttcctcatacttttttttctcttcatcctttccttctccaagggttaactttccaccttaggagaatcttttctgctttttctcccacttccccagctactctcttatcatctgctccaatctcaccctaattgatcattttgggaaaatatggtcagagtccagataactaagttgagaaatgcttaaactctgccatacctttccagtaaagaatattacctaataaataataaaatggtaatgggaaacctgaaccctgaaaaaaaagaggtggaaggagaaacatttggagcacatcctgtctacaaattaggaactgcctgtgttatctgttttatggttatattctagaagaagaaagggattttgtagcacctggttttgacctttctgcactgtttgttgagcaaataaaccttatgggctgttagccctctttatagcctctcagcttatccctggcccagacaccctgctgtcattttgacttttcattcccacacacacatacacatgcacacacatgtacacacacacacataccatttaagattagacagaagtaatgctcaaaatggagtggcttctgagacatttagtccaagggttcccaaacaggcttttcagtatcagatttctttctgccccattgaaatgctacacaaccttccgcttacagcaggtcacaagggtttcattctacttgaagtaggggccatgtcccatttccacttccttggcttcccattcagtcactgctaggatttgcctagacccctgaggccagacaatgtagaaacttctgctccatgtcacaggtgaggaaacaggctcagagagggacaggctccgaaagtcacatagacaacagtagggctgcggctcaaaccccagcgtctgactccaggtttagtgccttctcagggcatcagtgacactcctcatggccagggtgcccccagtgttgctcacagtctggtatccagggctgagagtgtgctgtgtgctcagactgcctgggttcagtcctggcactgccactttacagtcagtgacctcaggcaggttacttaagctctgcaggcctcagtttcctccttggtggggagggttatgaggcatccttctcatggtaaaccttcagtaaataccagccgttactaggagggtccactcctgcctctccactctccattcatcctgcctgtttcctctgcctgcttcctctgcctgcttctgtggtggtgaattcttcatggctcccaccgcctcctgctgcacccccactcagggcccgcatcaggacccttcctcctattggtttgaactccttggagtcagagggtaatggatagtggagtgagccaggtggcagaatctcagaggccatcccgggcctataagcctcttcaaaatagggccacgtatcaagctttacacacaggagtgaactttcacaagttgttatgactcatactctgtctatagtaagctgttaaccactcccatttggcttatgcctctgtaattattgtactaacttatatcttaaaataaggatattgaaggaatgagccgggagaggctttcctggttgagatatagaagaacaagagttgctctttttccttaaggtctctcctcccacccctgaccttagctcaccagcatgggagaatactatttgactccttgtactctgagacgtggatttcaagatatagcattccaacttcaacggcagcaagaaaagaagcaacagaaggagaagacatcatagcaaacagggatgcatgctgcatttcctaatactcaaacccggaaacgagacttcactcaaggtgaagggagggcaggtcaccacctggtagcactagccctaaattaaggaatgcagaatgtttgtgggattgcccatcataaaaattacaaaatgagtaaggaatgcaggcacagctggccaggtgggtttgtcacaaccatggcagccctttgccccacagccagtacacagaactggtctctccaattccgattgcatatcttctggcacctctgttcctctccctcagctgcccaggatttttctggttctgaccatgttacttcctcttttaaacctgttagcatttcacgactgcctacaggcaacggtctaaatggtcggaaggcccaagcttagcatccgagaccctgacctacctccagccacttcctcctcctctccacttcactggactccccatctccacccagacacctctgttctcccctctgtgtgcctttgcttatgctgtcccctgtgttcctagtgtgtctctggctatcttttaagcttccctccccaacctcattagttctgtggagcccctggaatagagctgacttctccttccctgctgctcccaggctgctcagaactttctggaaagggatgattatctgagttccagcctcaccccagcccccggactctgagtccctcatgtctgcctcccttctttctctctgaccacacagctggtacatagtcagtacagacgcagtcagtgagtggagcacggggcttctctccaggattcctgcccctttgtttatccctagtctcaggactccctactcctggtcttctgcctaaatctgtgcctcttggaagtgaagcctccgttcccagtggggccaggtcctgacccttgggaacttgcaggatccctcccttgggcctctccccgaagcttccagctcaatgctgaccagagcacaggctgcctgtgacagtccttggggtgacctcccttatcaggaaaaatgcagaaaacctattaataccttagccttgtgattgttaatggtcacaaaactcctttagggtcctttggactcagcacctttatggtctcactttgaattttgaacctcccacctccccccatcccccagagtaaggcaaatggtcttctgattgttcctgcagagggaaggctccacaggtaagcacacgatggccaggaagcagagctggagcctgcctgaaaggctgtggagaaatggagggagggctgccctgaggactctgtctggctttgaagttttctactgtttccttttcttctgtgcactgttttaggatgatggggtgatagttccaggctggttgaggatggatttggagacagtcctttgtaccctcagtgagcaagagtatctgtcaccctacctcagcagttgtctctgtcactggtccaagcagctggttcctacacaaggtcaagatcaactggggagaagcagactcctgggtctatcccattagtgaggacagctgcctgggcttatggcctcattggtttggtttctatcttgatcatctctaccatccccccatcccggccttccattttctacctcagctgtcagtgcacagattgatgtgtgtgggaacggagcttgggaggagtggggtagggctggtcctgtcctgtagcctccccttccttcgggcacttggaccctttggagcttgccggggtggggaatgggagtgggaaggccagggagtgtctctgcaccatcactgtttgagtgttgcccctttgctgtgtgccccacctagtctatgtgtgtctctgttctctggggactcaatttgctggtgaattgcttccatggacattgttctgggaaatgccattttttctgctcacccatgactctgtgacaaggaatgacagcttattaggaatttgtttttgcattggaacagtggtcatcagaatgggccccttttcccttgcagctttgacatttgcctctcttttcctcacctctctcccttgcatccacccttttctctttttcttcttttttgttttccttctagcaggggccttttacctttacttgttaatcctgtttgtagcaaagcaagtggaaggaggagttcctctctgatctgcttcttattctccacctaccttctcttctgtactttccgcctcctagagagagagagagagagaggaatgccgacctaactaccgctgccactgctgctgccaccaccgctgccaccaccaccctggtaatgttcacatgtcctcaaatcaacccagagccagggccctgctggtcagggggaggctatgtaaataatcccatgagtgtgccatcctcaggccctggggtctcctaggcaagaccagggcctctgtgggctctctcggaaatgctgaggttgctggaagccagcccgtcatacagggtctgagagtttaacttcttttaaattaaaccacagttgagctcatgctgtgtgtgtataaacttttgtatcctgctttttccttaaattctttatcatcagcatcttcccatgttatttcatagtcttcatcatcatcactttccataccttcatagtagttgatcgtagaattccatcataattaacttgtcttttctctcttagaagtcccttaggtaatgtccaattttccgtgagtgtaagtaataccataatgaacatcttggagtctgaagtttattctgtgttggtttgttccacatttaggatcattttcccaggctagattttcagatgtgggattatgggttcagatatggtttacacatttttatagttcttaatacagatggccaaattgctttctgaaagagaagcttttcttaagtatttttctccaacttgtatcttaaacatcctgaacatgcttagcaccactgtcttgatatatctgcggaaagccacgtctccacttttcagtgtgtcgggccctgggagaggcaggcatcctgcgctggctccttggagctgggtttaaaattgtctcctctggctgggcgcggtggctcacacctgtaatcccagtactttgggaggccgaggtgggcggatcactaggtcaggagatcgagaccatcctggctaacatggtgaaaccccgtctctactaaaaatacaaaaaattagccgggcgtggtggcgggcacttgaaaagtcccagctactcgggaggctgaggcaggagaatgatatgaacccgggaggcggagcttgcagtgagccgagatcgcgccactgcactccagcctgggcgacagagtgagactccattttaaaaaaacaaacaaacaaaacaaaaaaacaaacaaacaaaaactgtctcttctgtgctcacttcacccagaatccctgttgggctcttcaaggagctcagttctctctgaaagcaactttatagcctcagtccagtctgtgttcctgtgtggcaggggtcaagggtatgctcactcttgagagtggtgtctttggttgaccaagaaccactcccatagcctggtccctaacccttgaaggcccatctctctcactcactggggtgaagagtttaaatctcagatccaagttttgttgagagctctgagctaccatattgctatggttaacaatagttaacaatgttaacaatggttaactatggttaacaatagttaacaatgtttaacaactagagcccagctgggtgtggtggcatgtgctaacagtcccagcttctcaagaggctgaggtgagaagattgctggagtccaggagctcaaggccagcctgggcaacatggcgagaccctgtctcccctgcaaaaaaacaacaacaacaaaagcaaaactagagcccaactgctgtgaactcatggctgagtagatattattagccctccacaaactcagcatttgtataatcccaggctgtttccagtaattctctggggatcatctcccagcctgtccactgttccaggatccacacttaggcctataggaatgccccgtcagagcttctgctgccgctgatctgttactgtttcatgcaacccactcggcctagttccttcctcttactgtctcagtgggcacagaaaagcatacagagggtgtttcagcaaacattgccactggctgcagacctgcccccggatctgtcctgttgagagcttagtgctgcgttcttgcatggtggggaggggtgtggctctgtgatgagccagggcatgtgtataggagcaacagtgtctctcttatcacgtagaagttctgactcattgcgagtcttggctttgggttaatggttccagccatgttgctgctgtgtcttttggtgcaggagaggctgggcacagttggtccctaagccattatggataagggatgtgtctgctgatatacacacatggacctgacatccagggaaggcagggtgattggacagaacagttcttccagaagctgttggaacttggacaagagtggcccttggctttctgtagttggtcatctgtcccctgttgcaatcaggggaaggccacacttgccttccttaaccacagttaggattttcttggggattagaccagattctagcacctgtcctgaacctctcgccccgcccctacaaaggctgcttgcaagtgtagtgcacatacacagggagcaggtggggcatggaagtggaagtggagcccctgcctttggcccttgggggaggcactgtctgcttacccacggttgttgcctcataggaatcatacaacagcttcctaactggtctccttgccttcagttggattggggcacaaatccctccttgacatataaaccatggtttaaggctccctgtggcctaaataaagataaagcttaagtatcttaacaagcacctaacccttctccccagcctcggtgatttggctcatcgctgccttcatgtttcattctggcttcactcattcggaatttcttgtagttccttggctgttctcttttccttaccgcctttacaaatgctctcaccatgcatgcttttctctgctcctacagatgccttctctcccagcaccgcctccagagtctatgtctggtcgattctgtctgctgtctccagtccccatcttgtggcagtctctgctcaatcatttggggattttatatgttttctggcctttcttttgggggcctgtcttctccttctaaaagcagccagttgacctagaaggaagggataactgtaactcttgtctaccaacataagattaggcccaccctttaaaagctgcgtctttgaaagggacacctgcacccagcatgctggcttctcttcaccaagcgtgacttcctacgcatttcacaggcctccagaggtccccctgactctcttctgctgtgagaaactctaatcatgtaagccacaggctaattcccttgagccttaaatgtttttagtaatttcccattcatcagagaagcaggatttgggaggaattttgaagcaaacactacagaaggcagagtctccaggtaggatatctaagagacatttggaatggtctgactgttcaagatggatgggaaagcctcttcctgtaatgatagtagccaacatttgttgtcaggcagtggggccccatttttgagatggggtctctgtcacccaggttggagtgcggtggtgctgtcatggctcactgcaacctcagcctccccgggctgggtcttcttaattctgaaaaacccagcttttaaagggtggacctaatcttatgttggtagacaatgttgtctcatttaatacaatgcacatgctctccccataacacaaaagagggaactgaggcctggaggtgtgatgtaccccaagtcacatagctaataaataaagaagccagcattcctgggattaaaaatgcatgtgtctgtcactgtggtgtatttggtgcttgatcaatgtttacttgagcaaatggaggggcagaggtaccgatgagtgtgctcagtgaggagggcaggagtgaagctgggcgtcttcccgcctcttgtgagtggtggggcttggtgagcttgccagggcctgtctttcttatcaaagaaggtgtgtgccccagtgttacagcatttcacccaaagcagcctagaaaatgcttgacttttctgtcattccggggaggacactttcctcctccactgttctgctggcctggtgtacccacggcccctgatagatgatagcacctgctaaagtgcaccatgcccttccgtctcactgcatcccacagatgaggccaggctgggatgagggagaaagggagggatatatagttcaggttattttggaaaactgcctgaccaattttaagtctgggccggacactggggcatctcaccacgttgaaagggccgtggcaccccgggcggtgaaaggggctggaaccaggtctgcttcttgggcttctcctccagggtgccattgctcatgggccttggctgcagaggtgctcattcgtggttccaaaattccaattcctgggagaggaaaaatgcttagttcagtctcagttaggcctctgcttagatcaaacagccaaggccagtaggcccagtcctatggtagagacatggcctcaaagagccctctgctgcagttgttggggagtgtaccaagagaagggagcattgtcctgggctgggcagccctgggggtctagtgcatagatgtagaaaggctctgttggtatacctccctttgcttgttggaaagtgctcaacggggctgaattgtgtttgacagtgtaagtctgggctggggtgagggttgttacaagattgtcaagatgattaaatgaaatgccatttgaaacacttatccatgccttgtgtacggtatccccaccagtgaatattcacagtatattataataattccaacaacttcataattttcatatgcaatttctaaactttgaacttttttttttttttttttttttttgagacagtgtctcgctctgttgcccaggctggagtgcagtggcgcaatcttggctcactgcaacctccacctcccggcttcaagtgattctcctgcctcagcctcctgagtagctaggaatccaggcgcccgccaccacacccagctaatttttgtatttttagtagagacgggctttcgccatgttggccaggctggtctcaaactcctgacctgaggtgatccaccgccttggccttccaaagtgctaggattacatacgtgagccactgtgcccggcaattttttgtgtttttagtagagatggggtttcaccatgttggccaggctggtctcgaactcctgacctcaagtgatctgcccgcctcagcctccctaatgctgggattacaggtgtgagccaccacgcccagcctaaactttgaatttctttgaacccatgacttacacagaattagctgaacgcagaattccaaatcaactcagcctgtgggacagccaaaaaacacagtgtgcctttgggctccttcactcaccacgcggggttagaaaactttgtcagaggctttaaaaaaggagctcttgtgtgtaaaatgtttccttgattctctttctggtgcctctctttctctaagtggtttgcttccccgagttccccacctgagtctgggtggctgtggcacatctgtgcattctgtacgcacacaggcagccttttggagtgccagtttccaggtcttggttttatttatttatttatttatttttttgagatgggggtctcactctgccgcccaggctggagtgcagtggtgccgtcatggctcactgcaacctcaacctccctgggatcagttgagcctcctacctcagcctccagagtactagggaccaccatgcctggcaaatttttgtaattttttgtagaggcagagtctcaccatgttgctcaggctggtctcgagctcctagactcaagtgatctgcccaccttggcctcccaagtgttaggattacaggtgtgagccaccatgcccagcccaggtcatcttttgagggcatggagagaagactttgagcatcccacttttgagattgtgtaccagtcgcaagcccctatgacacactttttccccaaagtagagggctctgactatgttgatcccaagagagatgggaaagagcattgaatgaggattccaaagtattgggccttagttcgtttcctcatgttggtgttgtgaagattctggttaggataacagcatgtgtgcaggaggctttgtgaactgctgagagtgaggcgtggcaatgtcagtgctaggtttgtccttactaacctggggccatgggaattgataagaccagattcccaactctaccccacaatgtgatccctgtggtgacccctcacagggctctttggtcgagcttcccagaagggatcaccatctgccattgtatgttgaaccccattcattcattcattcattcagccaaccagcaactatttgttgagctcttattgtgtgagaagcagtcttcaaggaactgggtgaataaaaaaaacaaaacatcctaaccttcattgagcttacattcttactgaaagaaaacaaataaaacatacatgtaatcctagcactttgggaggccaaggcaggcggatcacttgaggtcaggaatttgaaaccagcctggccaacgtgaaacccatctctactgaaaattaaaaaaaaaaaaaaaaaaagccgggcatggtggcacatgcctgtaatcccagctactcgcgaggctaaggcaggagaatcgcttgaatcctggaggcagaggttgcagtgagccaagatcataccattatactccagcctcagtgatgaagcaagactccatctcaaaaataaaaaataaaaataaaaatatgcattccctttgcaccagcacacttggtgcctggggacctcgtggttggcaccctgaagcaggtgtccctcttctgtcttgcacaccttgcttctgtcctggtgtgtatggcatggccttctgccctccatggtgagcactgtgagggcagaggttgagttgggtttgctgtatttctcaggtgcctaggtttgtgcttgacaggtagatggaaggcacacaatgtggtcatcaaacctcagtcaaccatataaggaaggtagaagtgaaaagtcccataggtacccaactaatgtcaccagtttcctggatacctttcctggagtttatttatagtgtgtataaataaatgatgtatgtgtttaaatgcctttttcacctttccttttagagctgcctctttttaacagttccattccattgtatggatgtactatgatttattgaaccagttccctactgattattctgttttttgcagtcttttgttatgatgaacattccacagtgacaatgttgttcatagtcattcacacacatgcaagtccttctgcaggatatatttctagaggggaattgctgactcagaggttttggtactctgtgttgattgtagagtgacggcagaaaagtgaggcccaagagtttcctagtgaccatgtgtagtggacaagtcaccagtccctgtgagtgtttggcccaaaggctttaaggcatttgatatcactgtttttgtttctgcaccaggcgggagacactatattcaatcgtgctaagctcctcaatgttggctttcaagaagccttgaaggactatgactacacctgctttgtgtttagtgacgtggacctcattccaatgaatgaccataatgcgtacaggtgtttttcacagccacggcacatttccgttgcaatggataagtttggattcaggtaagagatactcagtcagaatctgtggtaaacatgtctctctcatgtgttgactaggaaatgcagtcctggcagctcaagagtgcctctttaagctctggagcagaatgcctcctctgagaaatgggtgctttgtattagttgagatggaaagaagagaccagaaatgcctgtagtctctgcacatccagacaaaaacaaattttccccccttttttttttttgtttgttttttgagacagggtctggctctgtcacccaggctggagtgcagtgccgtgatcttggctcaccgcaacctctgcctcccgggttcatgccatcctgtcacctcagcctcctgagtagctgggactacaaacacttgccaccatgcgcagctaatttttgtatattttgtagagatggggttttgctgtattgcccagtctggtctcgaactcctgagctcaagcaatccatctgccttggcctctcgaagtgctggattataggcatgtggcaccatgcctggcctaagaacagtttttagcatttgggaggggctctcatctttaagctccaaatgatactgtattttcttgcttttttctttctcttgccccacaagttttggaaagtaaattggaatagttttcccccactgaattatttagcttgtatacctcagcagatgttccttggcctgttttgttttgtttttgagacagggtcttgctctgtcacccaggctggagtgcagtgacacaatcatggctcactgcagccttgactgcctgggctcaatccatcctgcagcctcagcctcctgagtagttgggactacaggcatgagccagcatgtccagctaattttttatttttagtggagatgaggtctggctatgttgcccaagctgggcttgaactcttgggctcaagtgatcctctcacctcagccttccaaagcattgggattacaggtgtgaaccactgctcccgcccttggccctataagaaggaatgtgattctgttttccagcagggcacaaacttctgcttaaatacaaagcccaaatttttccaccaaaatgcccctagtgaagtggccagcccagatgcccgactagcgtattatccaaagcatattgtcattggtggaaaatggccttatagtccattgttttgtcttaaaagtaaatatataaataaacttgtatattgtttcctaattccgtgtttatattaacataaaagtgttttaaattacctgtcagtggccaggtgcagtggctcgtgcctgtaatcgcagcactttgggaggccgaggcgggcagatcacctgaggtcaggagttcgagaccagcctgaccagcatggtgaaaccctgtctctactaaaaatacaaaaattagccaggtgtggtggcaggtgcctgtaatcccagctactcgggaagctgaggcaggagaattgcttgaacccgggaggcagaggttgcagtgagttgagatcgcgccattgaacttcaacctgggcaaacagagcaagactctgtctcagagaaagaaaaaaaaaaacctatcagttgaataacaaaaccctttccttccttgctttaagtgaatctgaagatccaggagctgtgctgcaggtaccctctatgttgggtacccctggtttaggctgactagtacagtgtggttggctcatgtagacagcagaccctttattttagatacaactttttttctttttcttttattttttttgagacagagtcttgcttgtcacccagcctggagtgcagtggcgtgatcatggctcactatagccttaaactccctggctcaagtgatcctctcacctcggctttcctagtagctgggaccacaggtgtgggccagcacccctggctgatttaaaaaaaaaaaaatttttttttttagagatgtctcactatgttacccaggctggtcttgaactcctgggggctcaagcaatcctcctgctttgacctcccaaagtactgggatgacaggcatgaactactgcacctgctgagatgcaacagctttctgtcagactcattttattctcatcatttcttcctgtcctcccttgctgggagcatgagagctgtgatgggaatataggaatgtatgaagtccttctcccagatcaaaaatcctaacttcttgtcttaaagggaggaaaatttgaatgtaaccttacttttagactcttcagaaatccttctatacccttccgtccccgctttcacccttcctccctctccgtgtgtgtatcttcttctcttgaaacacacaggtttataccctgacccctcttgattcatcccttgaagcacagtggtgaacaaggaaggggcccgtgatgccctaattctttgccacagcaccatgtttgtttcacaaggagcctggcaggtttgggcttggggcagataggggagagaaagcagcagagacagcaaaaccaaatcatgtcagcttggcatgtacttccctctgaaatagctaagaatccatttctgtaaaagcactgattatcagaaaaccttattggcctggccacctttggttcaaaccctcacattaataatgtggacagtagtatgaggtgtgccaaaggtggatgactcggcacctaagtgatgacacctaattacgaataggttcattaaagcagaccccctggggacctttgcttgaggatccttacagtcagaattcctgaatatatttgaaaataataattgcatctttattttcatatgttctgtatggtttggctgacttccccctcaaagtctgagttagagttttccttaatttatgtgatgggtttggtctttttggattccagaaagagctgggtgtggtttggagctgcactcagagtcacacaaaaccacagcctttagagaacccacaggaaggctttggggcacgtcctgattcttgacatttctcatcagtgctgactttgtatcccttaggagttcacaattcataaccactgaaatattaaaatacaaaaagttttggaaggatgagagcccagatgctctactacttgaaaatatgttaaaacataagttcatcattatacattttgctaaatcaggataaagtctgaagtttcaaagaagttttattttagcaaattttcagaaacactgcctcaactgttagggccagtgttctagtcagtatgcctttggaagcatgaaagctggattggtcgataggatgggtgtggaaggggggctgtgactgggtgggtacagagaggctctgaaacaatctcagattccaggagttcctggataaggacttcatgtgcgggaacagagcacaggagaagcagattcctgagccactcaggaagaactgggcctaggcctgctcttgtcactgactggctttctacataaccacagaaacagcactgtgttgtagaaagaggaagatcatactttttgatatctgtgtctaatttaaggtcatctgagccctgatagaaaagcaaaacagacaaaacccttgtaactgctccctcccaccccacccaccatcaaaaaagctttagagaggctggacatggtggctcttgcctgtgatcccagcactttgggaggctaaggtgggtggatcacctgaggtcaggagttcgagaccagcctgaccaatatggtgaaaccccatctgtactaaaaatacaaaaattagccaggtgtggtggcacacgcctgtagtcccagctacttgggaggctgagacaggagaattacttgaaaacctgggaggcggaggttgcagtgagccgagatcacgccattgtactccagcctgggctacagagcgagactccttcaaaaaaaaaaaaaaaaaaagatccggtttggtgtcttacaactgtaatcccagcactttgggaggccgaggccggtggatcacgaggttaagagatcaagaccatcctgaccaacatggtgaaaccctgtctctactaaaaattagctgggcgtggtggcaggcgcctgtagtcccagctcctcaggaggctgaggcagaagaatcgcttgaacccgggaggcggaagttgcagtgagcctagatcgcgcccctgcactccagcctggcaacagagcaagactacgtctcaaaaaaaaataaataaaaactctagagaagcaaaaagaataactttaaaagtgtttatgttctcagcaagctttattttggggatgtcagaacttaactaaccactgctccttctgtgtgtatgtttttcctccagcctaccttatgttcagtattttggaggtgtctctgctctaagtaaacaacagtttctaaccatcaatggatttcctaataattattggggctggggaggagaagatgatgacatttttaacaggtaatggtcataacttagatatctttctcctctgtcaaccttcacttccagttttttaaccaatgcttggttgttccccaaggactgaccctcagatgggatgcacccctagtcagcccacattcttaggtgtggcttcctacaggtcctgcaggtgctaaaagggatctgtaggaaaatgagtttctgagatttttgtattggcctggaaaaatgtcaaatgggaaccaagtgacggggcaagtttactttgacttgctgcatgccgttttgtactcaaggagtaaaccaatgtcctttgtaaaaatccctcctttcattatggtcccctttcactgtgaaacaagtttccttgagcagaatcctaactgtcttcacagaagctttgtgttatatttttattttggagtattttcacatatacaaaagagatactgtagtataataaacctttgaggacctatccagccccagcaaccattatggcctggtcagttctgtcccatccacatcctggggctctttttaagctggtaaatcattatgatgtgggttgtcatttacagtggtaaaaaacatctatcagtagcatttgaaagaacattctgctcagtcctctggctgtagaggcttcaaccccaccagccaccgatgagcaccttctccctccaggagccagtctgagctcattactgagtttaatatcagaatacaccctggtgcagcctttctaaattgcagtaccagttaacagaaggtgtctgtcagagcaacacccaagtcattcaagttaccattgtgtgcaaacttaacagagacccacgtcttcaatataagccttgaaggaaactccagttttagtatgtagatggggtatcaagtgtgtgcacattgaacatctgctgcatacagagcactgtgccaggcaggcccaggacactgaaaacctggacatagggtccagacagaagcaagcctgcttccacagaggcactcctgggcagacactctggactgatatgacagtgtgcagggccgacaggataccacaggtctgaatggtcagaacagctggggagggagggagcatccgcaggcatctagtcccatgctaacgcagtggcactagaaggatgggtggtgtgtggagcaactttcttgaaagataaaggacctaacactttctatgcaccacttactgtgtgccaggcaaggccaggaatgtttaagtggtctgggatcagccagttctgcctcttaactaactttgctgtcctgctctccaggctttcattttggtcctcattccttttccttggaccaacacagaatcctccaccctgttctggctgcctctagtcttgttctcagccctccatttgtttttttctgccttttcccacatgttctgaagccctccattcgtatactactttccagagagacttccccatggctaaaagcattttggaaatactgtatattaggcccctttcagatactggcaaccgtttgtgggatgctctgagaaggcctctgtgacttagcctggcccttttcagcccatcacctgccacgtcctaccccagacccttgtcaccagtccccaggagcttacgttgctccctgagggcactaggcttgctctcacttccatgcctttgcctgtgccatcctggctgcccaaaatgctatggcagatacctgttcatcctcaactgggctctgcctaggcttgctccagcagaggttacaaactctatgcttcttcctctgtgtctccaacctcatcttcctcttctcacctccatcctggccctaaaggccctatgtttgaagcattcacactgtatattctgtggggcacacggccccagtgtctggcacatggtagtcaacaccacaaaccgcagaaccagttgtaaaaggacatggagtcggaatgtgagttttaaccagggtcatgctgggctgggttctggcatgatgctgggttgtgggctgagtgagaacagcaagggtgatggtggatggagcaacagtcttgcagccggggctctcaggccaagtgtatggcagctctgtgataatgactttccctttactctttgcagattagtttttagaggcatgtctatatctcgcccaaatgctgtggtcgggaggtgtcgcatgatccgccactcaagagacaagaaaaatgaacccaatcctcagaggtgcattctttgtttattcatactccttccccctttaggatgaggtaggctgcaggtccgaggctctgggcctagagggaaattgaggtggtcaggttacagtggagagggaggaggaagtacgtgtgatgatttcttcttaagatttttgttttaagacaatctccttgtgctcttttccttgtaggtttgaccgaattgcacacacaaaggagacaatgctctctgatggtttgaactcactcacctaccaggtgctggatgtacagagatacccattgtatacccaaatcacagtggacatcgggacaccgagctagcgttttggtacacggataagagacctgaaattagccagggacctctgctgtgtgtctctgccaatctgctgggctggtccctctcatttttaccagtctgagtgacaggtccccttcgctcatcattcagatggctttccagatgaccaggacgagtgggatattttgcccccaacttggctcggcatgtgaattcttagctctgcaaggtgtttatgcctttgcgggtttcttgatgtgttcgcagtgtcaccccagagtcagaactgtacacatcccaaaatttggtggccgtggaacacattcccggtgatagaattgctaaattgttgtgaaataggttagaatttttctttaaattatggttttcttattcgtgaaaattcggagagtgctgctaaaattggattggtgtgatctttttggtagttgtaatttaacagaaaaacacaaaatttcaaccattcttaatgttacgtcctccccccacccccttctttcagtggtatgcaaccactgcaatcactgtgcatatgtcttttcttagcaaaaggattttaaaacttgagccctggaccttttgtcctatgtgtgtggattccagggcaactctagcatcagagcaaaagccttgggtttctcgcattcagtggcctatctccagattgtctgatttctgaatgtaaagttgttgtgtttttttttaaatagtagtttgtagtattttaaagaaagaacagatcgagttctaattatgatctagcttgattttgtgttgatccaaatttgcatagctgtttaatgttaagtcatgacaatttatttttcttggcatgctatgtaaacttgaatttcctatgtatttttattgtggtgttttaaatatggggaggggtattgagcattttttagggagaaaaataaatatatgctgtagtggccacaaataggcctatgatttagctggcaggccaggttttctcaagagcaaaatcaccctctggccccttggcaggtaaggcctcccggtcagcattatcctgccagacctcggggaggatacctgggagacagaagcctctgcacctactgtgcagaactctccacttccccaaccctccccaggtgggcagggcggagggagcctcagcctccttagactgacccctcaggcccctaggctggggggttgtaaataacagcagtcaggttgtttaccagccctttgcacctccccaggcagagggagcctctgttctggtgggggccacctccctcagaggctctgctagccacactccgtggcccaccctttgttaccagttcttcctccttcctcttttcccctgcctttctcattccttccttcgtctccctttttgttcctttgcctcttgcctgtcccctaaaacttgactgtggcactcagggtcaaacagactatccattccccagcatgaatgtgccttttaattagtgatctagaaagaagttcagccgaacccacaccccaactccctcccaagaacttcggtgcctaaagcctcctgttccacctcaggttttcacaggtgctcccaccccagttgaggctcccacccacagggctgtctgtcacaaacccacctctgttgggagctattgagccacctgggatgagatgacacaaggcactcctaccactgagcgcctttgccaggtccagcctgggctcaggttccaagactcagctgcctaatcccagggttgagccttgtgctcgtggcggaccccaaaccactgccctcctgggtaccagccctcagtgtggaggctgagctggtgcctggccccagtcttatctgtgcctttactgctttgcgcatctcagatgctaacttggttctttttccagaagcctttgtattggttaaaaattattttccattgcagaagcagctggactatgcaaaaagtatttctctgtcagttccccactctataccaaggatattattaaaactagaaatgactgcattgagagggagttgtgggaaataagaagaatgaaagcctctctttctgtccgcagatcctgacttttccaaagtgccttaaaagaaatcagacaaatgccctgagtggtaacttctgtgttattttactcttaaaaccaaactctaccttttcttgttgttttttttttttttttttttttttttttggttaccttctcattcatgtcaagtatgtggttcattcttagaaccaagggaaatactgctccccccatttgctgacgtagtgctctcatgggctcacctgggcccaaggcacagccagggcacagttaggcctggatgtttgcctggtccgtgagatgccgcgggtcctgtttccttactggggatttcagggctgggggttcagggagcatttccttttcctgggagttatgaccgcgaagttgtcatgtgccgtgcccttttctgtttctgtgtatcctattgctggtgactctgtgtgaactggcctttgggaaagatcagagagggcagaggtggcacaggacagtaaaggagatgctgtgctggccttcagcctggacagggtctctgctgactgccaggggcgggggctctgcatagccaggatgacggctttcatgtcccagagacctgttgtgctgtgtattttgatttcctgtgtatgcaaatgtgtgtatttaccattgtgtagggggctgtgtctgatcttggtgttcaaaacagaactgtatttttgcctttaaaattaaataatataacgtgaataaatgaccctatctttgtaactgcaggtggtttctgtttgccaggtgtaagggttgtcatggctgtgggatggggtggggacagggtcattccctggtctgtgacccatacaaatacacatgcctccctggaatcagacatttccccatctgaacttcattctcttatctgtaaaatgggaataataacacatagggacttttttgaggcttaaaagtgacgatatatgtaaaacaatgactaatgcctcacaagtactcactacatagtagctagtgccatttcaaagtagaatttttttcccctagcagttcttgggccacattctgctattttcaacagataccaggatcattcagatgtagatctcagggccatttgcaccaggtgctcacagtgtaacttgaagggaattatccaaaatgaggtttcttgtcagtctcaggaaatgtaaccataagctctaaaaggtcttagtttttacccaggtgcctcctccttggtggccctgggtcaggctggttggattgaattggcactcctgaagaagggctgcaggaaaccagtgagcaggagagccacccttggcagggagctgcaggccctgcctgcatgtcactgctggagggatccctggtgacctcaggcctgtgcaaaggtggcctggggttcagatctggccttcaaacaggacaactctggtcctttggacaaaatgctgccttagagggtctgacaaaattaaaaacaaacaaaaaaaaacctgtttctttccttctcacacaccaccactcacaacacttcagttctgcccctagatatgtagggatttctccccaccaacaagcagttttctagtggacactagctgggtgtcctacagtttaactcaattctgacactgtctgcctggagatagcaacggatcccacaggttgagggctcagtctcacaagactgcctccactgcagatgccagtcacaagtagttggttgtgacctatgctttacaaaaatgttttttggatacagggccttgctgtgtcacccaggctggcctgaaactcctgggctcacacaatcctcccgccacaacttagaagtagctgagctgcaggtttataccactcacccagctatagttgtgacctatacttctgaccaaccagctataaattggggtttctatgagcctcttcttgggtttaatttgctaggtcagcttacagaactcagtgtaacacttaacatttactggtcttattataagtgatattagaaaggataccgatgaagaaccggatggagagatgcatagggcaaggcatgggggagggggagagaagcttccatgccctctccaggggctccaccctccagacacctccacgtgttcagctatctggaagctcatctgaccctgtccttctggtttttatggaagcttcatcacataggcctgatagactacatcatcggccattgccagtcagctcaaccttcagcccttttccccttcctgaaggatgggagtgggactgaaagtgccaaccttctcatcatggcttggtctttctggtgaccagtccccatccaggagttcactgagaatcatttcattaaaacaaaagacgttcctatcacccgggaaattccaagggattagaagctctgtcaggaaccagggtcaagcaccaaatattagaacaaaagattctcctagcataaatattagaacaaaagattctcctagcataaatattagaacaaaaaattctcctattgctcaggaaattataagagttttaggggctctgtaccaggaacccagcgcagaggccaaatatatatattttattatctcacagtgccacacaggactttgcaagctgtcaggtctgagtgagatggagcacaccagtgaaaggttaagttcaccctttcactgatgtgctccacttcactgagacacatatccacacagacacacagagacacacacatccacccagacgcacgcatccacccacacacctccacacatgcctacacactaacatgcataacacagctgacatatgcctatgagaggtcagaatacctggattcaaatcctgccactgcctcttattctgtgaccatgagcaaatgacttggcctctctgtgcctcagtttctcacaaaatgcctttcagaattttttttttttttttttagagacagagtttcaatatgttgaccaggctggtctcaaactcccggcttcaagcaatcctcttgcctcagtctcccaaagtgctgggattgcaggtgtgagccactgcacctggcccctaatttttctattatttgtttgttttttagagacagggatctcactatgttgcccaggctggattcaaactcctgggcttaagtaatcctgcctcagtttctggttctgtgtaatgggagttataacagaacctatttcatagggctgttatgaagattaagtgagttaataccatacttatgaagcacttagaacatgcctggctcataataagcacgacaagtgttatgcttgtttaattgtttgaaattcacgtgggcatatgtgttgacatatacagactgccatgtacatattgcacagatatacatatgcacacactcaggtgctggggatcttcccttttcctcttctggggcacacgtcttgaactttgctatgtggcagctgggtgagtaaacctcagggcgagtgactgctgctattctggagacacccaggacctcaccaacagtgtttcccccacccttccactccccacctgagtgaaggtgtttaggatggcagccttggggagggaaagaggtttaaccccctccccatgggctccaagggaccagggagggaggaaggaggaagagggccaaggacaggctcctaggctcagccatttcctcgagaaatgctctgtttctagtctcatacaggacccagaacaaccaagtctgagccaagcagagccccttaatcatgagagtaatcaccagatcccccacataccacctcttttccatgggagaacgtggcccaggtgccaaatcactggcctacagctgttctttggaggcagggccaaggggcccaaggaggcggctgcccctgggggtgaatgagtggcgcctccctgggcgagacatgtttgctgctctcgactgaggccagctgtgtgggggtggggggagaggggagggaatgaggatgatcacattgaccacattctgaaggttaccaagtttctgccacatatccaggctccttccctcttgtttcttccaggaggtgggatttcagacattcctaagggctggtttcttcttagaactggaacttcttaccatgccagaaaggaaatgaggtttgtctggctgagccggtcatggcaggcaagcctcatttccgtctttggcagtgtccccaggcagggaatgtggctactgcctttttctgggcttcaggacctgtacccaggctgtgaggcagaggaaccccaggtgcagaggaggttgttatgagtgacagggtcaatagactggaaaccagaggaacatgacaccccaaggacatttgccctgcagcgagatgtgttccagggtcaccaagagtagagagagggcacaatgatatcacggtgtatttggggagagtgagtgccaggtcaccaggcagggagcctggaaagacaagccaggaggaagccatacaatgaccattacgtgtggctgtctctgactccccacttgctgtgtgatgctgggcaagttggttcccctctctgtgtctctgtgtcttctgtaggaagtgccctgctgttgacttttcctcttgccctgcgactaaccttctctgtcttcttgagggaagtccatttatttctgggtcatcatttgtaaaagcagcaggatcaccccttcctgctctcctccctccctgcctccctcccagggcttcctggagcatcacggggtaagctattaaagttctacctggtgagggagggctggcatggcgttggagacatctccctcttgtgcccaatgccatccacgctccattgctgtccctcagaagtgcttctttgtctccatccttcctctcacctgctcttccttaacttccaaaactcaggcttcctgatcatcccctaccaagctcagcagggtcaagagtacccaggggcctgagggagaagcacagggatgcggacagggtggctgtacctctgctcagctcccaggagtaagaaatagggttaagaggagcgtgggagcaaactccctacccaggcttctttcagctgggccatctgtcctttgacaaagggatctaggatttcctgaccttaagaaggctcccttaagtggaaatgcagataaaaatcacaaagagatacaccaatttggatggttattattttaaaaaccagaaacacaaaataagtgttggcaaagatatgcagaaattggatctgatgttagtcattgttgattcagggtaaaagaaaagaagaaattggaatacttgtgcattgctggtaggaatgtaaaatggtggaacccctatggaaaatggtatggaaattcctccaaaaattaaacatggaattaccatagaatgcaacaagtccatttttagctatatacccaaaagaaataaaaacaggagcctgagcagatactagttcctagcactattattcacagtagccaaaaaaaaaaaaaaaaaaaaaacccacgagtccattgatggataaacaaaaggcggtatatacatacaatggaatatcggtcagccttaaaaggggaggaaattctgacatatactacaactcagatgaaccttgaagatattatgctaaccgaaataagtcagtcacaaaaggacaaatatcatatgattgcacttagacgagtcagctaaaatagtcaaactcacagagacagaaggcagaatggtggttgtcaggggcatggggaagggaaggggaatggggagttattgtttaatgagtacagagttttagttggggaagatgaaaaagttctggaaatggatggtggtggtgcaacaatatgaatgtactttatgccacagaactttacattggcactctgcccccgatgactgacttttcagttgctacctgttcccatttaaaaatggttaaaatgggccggcttggtggctcatgtctgtaatcctagcactttgggaggctgaggcgggaggatcacctgaggttgggagttctcgagaccagcctgaccaacatggagaaaccctgtctctactaaaaatacaaaattagccaggcgtggtggtgcatgcctgtaatcccagctactagggaggctgaggcaggagaatctcttgaacctggaaggcggaggttgtggtgagccgagattgggccattgcattccagcctgggcaacaagagtgaaactccatctcaaaataaataaataaataaggttaaaatgtggaggccgggcgcagtgagtggctcacgccagtaatcccagcactttgggaggccaaggtgggcggatcacttgaggtcaggagtttgagaccagcctggccaacacagtgaaaccccgtctctactaaaaatacaaaaattagctgggcgtggtggcacatgcctgtaatcccaggcactcaggaggctgaggcaggagaattgtttgaacccaagaggtggaagttgcagttcatttacttagcacgtcactgcactccagcctgggcaacagagtgagactgtctcaaaaaaaaaaaaaaaggtaaaatgatgcattttctgttatgtgtattttaccacagtatgaaaaaataagaagactcctgtggtgaaggcttcgcctggtctgttctgctctggaggtggcagcgcatggtggttagtcccagcatcttcctggagatttgagcgtgagacgtgctggctgtgtgggctgtgccacctgaggaggattggccagtcataaggactcagcctggttgctgaatccagctggggaccttgaccccagtgactggcttttcagcggctacctgttctcgagacaaatgctgtcctcccctaaggagtctgggctgtggcaaagctatgacataggtacaaccgtccttttgccaggtggggcttaggtggagaagttgaagcctggactcagtcaagatctcaggactgggagcaaggagcctcttactcccagggtgcccacttggttcccactgactgttggtggaaactaggggctgagctggaggctttttagaggaagaaatgacaagctgggggctggattatccctgggggtgaaaatggagtcagctagataggttatgtcttgaaggagaggagggtcccctggtgtcaggaagcagagcctgaactccatgttagaccctggattggagagtgggcaggacacttgggagagacaggacttggtactggcgagggtactaccacacccattctgggagtggactatagagaaataaatcctaaaagtggacctatcttttgacctcacaagtcaacttctaggaattcatcctaagaaaacaaagtcacaccccaagatgtatgtgcgtcagtgttcgccctagtgctgtttgtagccctggaaaatgagaagccaccgtcaacgggggactgtgctaagtaaaatgaagtacatccaaacaatcaagtactatgcaaccattgagaatgatgaagtggatctatatttatcgattggaaagaggcctaaggaaacaaaggaaactacagaatggtctttccatatgaggcagggaaatgtatgaataatttagtgcagaaattactctgtaattgtttctgggagcagatgcatgagcaaaaaattgaagatgattttccttctctacatagcctggggccaggcccctgttctaagcgtccccgccccaccctgggctgaggcctttgttcagaatgttggccctgttgagaggacatgctgggttgtcttctgggaggagttgcattccccataagtcccccagtcttggaagggtgatgcagggttcctcccctgggggaatggtggaggcctgaactctgttcacaggtggtgggaaatggcatggctgtaggaaggtctgagaaggcagaatgggagctcaacacaggctgggggggcttctggcaattctctcaggtttagaaaaatagttacaacatttcttgccactcttttgtgagggcaattgaactgtcaagcctcaagacactaaagaatggaaagaatgcggtaggagaggaacactgtcttggctctggaggggcgagattcgcctcttgtgcctgatcagagctcgacaagggggaccccttttctagtagatctttgactccagaatctaggagccctgttgcagagggaggccctgacatctggattttgacacagacctgagcctggagctgttggaaactcatttctgggacagatgtggaatgctggacaatcaaacgtcgccggggcctttggagtgctccctgtgtcctgttgcggtggccacagtgactttggtctcccctgatgacagaagcacaggagaaaggccagctccatggcccagctcttagttcccaccttcctccaaggcgggcctgtggggcagggagggtgcaggtggactcgtgaacccctcacccgtgttcaccctccatgagcacactcggcgctttcccacgtaccgtgtgttgctccttacaataattccagcatgggaaacttaggctcagggagctcacatgacttgcacaaggtcacacagagtttgggtctgacacagacctcctgagtcccaggctagggctctggccactggaccatgacccagctcctcatccacacagtgtgggagcagggcgatggaggctgtgaggttccttgccccagccagggaagctgtggcctcagcagcactgccgagagaagtacagcctggatccagggctggagccaagagcacctttgggatgagattgtttgtgttttgttttgttttccctttactgttttagaggacttaggaacctagtaaacttgacagcgacagttccgtataccaggggcattgcattggtgtcaccacggtctgggagatgtacaggaatggttaacactgaaacaatccatgaggatgcaaagaggcctgaggcgtggggaagagggaagaagggagactcctgagggctggggatgcaagtggacctgaagacatggggttttctgcctctgaagcatcactctgggcagcaacaaccagttcctgcttcatggacaacacagcttcttaatcctcctggacctgccctgcctgggccaacacctggtgctcaggagggctcagcacagtgtctgtctgaagactgcggggacccagaagtccaggtggagacctaggattccccaataaggcctagatgcctgcttagttctccctttctcttctgggcacctttcctccccgactgtacaccctcttcccaagggagagcaattgccacactattccaagaccccctgtaagttctcagccaaaggcattttcctaagcgaagccaggggctgtggtttgttttgatgacaagctgaatcaagactgctaaaaagcaggctgttgggtttaacttcatcaactccaagcctcaatgatttgtgttccatgtggtttgctctggatagacactgacctagtgacaatgagactatggaacggggagagaagaattgcatgctgaggacaggagaaatcttccccatgaacaatttgtctgttgggcatgacatctcatatgtcagcttgggccattcctaccagcttggaatgctctgtgtctgactcagatgctgtgtgtgtctcaagggcgctgggcttggtggcctctgtgaatttggctggcagatcttggccctgctggctcccaggatccatgggcactcttcctgtcttgggtctaccctgtcgtgcaggttcactgcccacaacctccgggagactgttccaagggttttctttgtgggagacaaggcctgccaggcctttccctggcccctctccaaccctgatgtcagtacacatcctagcatactgctgggaatgcctcaatttgagggagtgcaattagttgagggaactgaggaagtgctgtaatgggagtctagggttgacccctgggtgaccaaggccagaatgtcaaaggcgtttgaaccagagcaactccatcttgaactggggctgggtgaaataaggctgaaacctactgggctgcattcccagaaggttaggcattcttagtcacaggatgagactgaaggttggcataggatacaggtcacagaccgggcgtggtggctcacacttgtaatcccagcactctgggaggccgaggcgggtggatcactggaggttaggagtttgagaccggtctggccaacatggcgaaatgccatctctactaaaaatacaaaaattaggcatggtggtaggcgcctgtaataccagctactcgggaggctgagacaggagaatcgcttgaacctgggaggtggaggttgcagtgagccgagatcacaccattgcactccagcctgggcaacaagagtgaaactccgtctcaaaaaaaaaaaaaaaaagatacaggtcacaaagaccctgctgataaaacaggatgctgtaaagaagccaaccaaaacccaccaaaaccaagatggtgatgaaagtgacctctggtgtccttaccactcactatatgctaattataatgcattcgcatgctaaaagacactcccattcccatcagtgccacgacagtttaaaaatgccatggcaatgtctggaagttaccctatacggtctaaaaaggggaggaaccatcagttctgggggaaatccccacccctttcccagaaaactcacg

SEQ ID NO: 2051 - DNA, 4045 bp, Homo sapiens
agctctcagccgctcgcccgcccccgctccgggccctcccctagtcgccgctgtggggcagcgcctggcgggcggcccgcgggcgggtcgcctcccctcctgtagcccacacccttcttaaagcggcggcgggaagatgaggcttcgggagccgctcctgagcggcagcgccgcgatgccaggcgcgtccctacagcgggcctgccgcctgctcgtggccgtctgcgctctgcaccttggcgtcaccctcgtttactacctggctggccgcgacctgagccgcctgccccaactggtcggagtctccacaccgctgcagggcggctcgaacagtgccgccgccatcgggcagtcctccggggagctccggaccggaggggcccggccgccgcctcctctaggcgcctcctcccagccgcgcccgggtggcgactccagcccagtcgtggattctggccctggccccgctagcaacttgacctcggtcccagtgccccacaccaccgcactgtcgctgcccgcctgccctgaggagtccccgctgcttgtgggccccatgctgattgagtttaacatgcctgtggacctggagctcgtggcaaagcagaacccaaatgtgaagatgggcggccgctatgcccccagggactgcgtctctcctcacaaggtggccatcatcattccattccgcaaccggcaggagcacctcaagtactggctatattatttgcacccagtcctgcagcgccagcagctggactatggcatctatgttatcaaccaggcgggagacactatattcaatcgtgctaagctcctcaatgttggctttcaagaagccttgaaggactatgactacacctgctttgtgtttagtgacgtggacctcattccaatgaatgaccataatgcgtacaggtgtttttcacagccacggcacatttccgttgcaatggataagtttggattcagcctaccttatgttcagtattttggaggtgtctctgctctaagtaaacaacagtttctaaccatcaatggatttcctaataattattggggctggggaggagaagatgatgacatttttaacaggtttgaccgaattgcacacacaaaggagacaatgctctctgatggtttgaactcactcacctaccaggtgctggatgtacagagatacccattgtatacccaaatcacagtggacatcgggacaccgagctagcgttttggtacacggataagagacctgaaattagccagggacctctgctgtgtgtctctgccaatctgctgggctggtccctctcatttttaccagtctgagtgacaggtccccttcgctcatcattcagatggctttccagatgaccaggacgagtgggatattttgcccccaacttggctcggcatgtgaattcttagctctgcaaggtgtttatgcctttgcgggtttcttgatgtgttcgcagtgtcaccccagagtcagaactgtacacatcccaaaatttggtggccgtggaacacattcccggtgatagaattgctaaattgttgtgaaataggttagaatttttctttaaattatggttttcttattcgtgaaaattcggagagtgctgctaaaattggattggtgtgatctttttggtagttgtaatttaacagaaaaacacaaaatttcaaccattcttaatgttacgtcctccccccacccccttctttcagtggtatgcaaccactgcaatcactgtgcatatgtcttttcttagcaaaaggattttaaaacttgagccctggaccttttgtcctatgtgtgtggattccagggcaactctagcatcagagcaaaagccttgggtttctcgcattcagtggcctatctccagattgtctgatttctgaatgtaaagttgttgtgtttttttttaaatagtagtttgtagtattttaaagaaagaacagatcgagttctaattatgatctagcttgattttgtgttgatccaaatttgcatagctgtttaatgttaagtcatgacaatttatttttcttggcatgctatgtaaacttgaatttcctatgtatttttattgtggtgttttaaatatggggaggggtattgagcattttttagggagaaaaataaatatatgctgtagtggccacaaataggcctatgatttagctggcaggccaggttttctcaagagcaaaatcaccctctggccccttggcaggtaaggcctcccggtcagcattatcctgccagacctcggggaggatacctgggagacagaagcctctgcacctactgtgcagaactctccacttccccaaccctccccaggtgggcagggcggagggagcctcagcctccttagactgacccctcaggcccctaggctggggggttgtaaataacagcagtcaggttgtttaccagccctttgcacctccccaggcagagggagcctctgttctggtgggggccacctccctcagaggctctgctagccacactccgtggcccaccctttgttaccagttcttcctccttcctcttttcccctgcctttctcattccttccttcgtctccctttttgttcctttgcctcttgcctgtcccctaaaacttgactgtggcactcagggtcaaacagactatccattccccagcatgaatgtgccttttaattagtgatctagaaagaagttcagccgaacccacaccccaactccctcccaagaacttcggtgcctaaagcctcctgttccacctcaggttttcacaggtgctcccaccccagttgaggctcccacccacagggctgtctgtcacaaacccacctctgttgggagctattgagccacctgggatgagatgacacaaggcactcctaccactgagcgcctttgccaggtccagcctgggctcaggttccaagactcagctgcctaatcccagggttgagccttgtgctcgtggcggaccccaaaccactgccctcctgggtaccagccctcagtgtggaggctgagctggtgcctggccccagtcttatctgtgcctttactgctttgcgcatctcagatgctaacttggttctttttccagaagcctttgtattggttaaaaattattttccattgcagaagcagctggactatgcaaaaagtatttctctgtcagttccccactctataccaaggatattattaaaactagaaatgactgcattgagagggagttgtgggaaataagaagaatgaaagcctctctttctgtccgcagatcctgacttttccaaagtgccttaaaagaaatcagacaaatgccctgagtggtaacttctgtgttattttactcttaaaaccaaactctaccttttcttgttgttttttttttttttttttttttttttttggttaccttctcattcatgtcaagtatgtggttcattcttagaaccaagggaaatactgctccccccatttgctgacgtagtgctctcatgggctcacctgggcccaaggcacagccagggcacagttaggcctggatgtttgcctggtccgtgagatgccgcgggtcctgtttccttactggggatttcagggctgggggttcagggagcatttccttttcctgggagttatgaccgcgaagttgtcatgtgccgtgcccttttctgtttctgtgtatcctattgctggtgactctgtgtgaactggcctttgggaaagatcagagagggcagaggtggcacaggacagtaaaggagatgctgtgctggccttcagcctggacagggtctctgctgactgccaggggcgggggctctgcatagccaggatgacggctttcatgtcccagagacctgttgtgctgtgtattttgatttcctgtgtatgcaaatgtgtgtatttaccattgtgtagggggctgtgtctgatcttggtgttcaaaacagaactgtatttttgcctttaaaattaaataatataacgtgaataaatgaccctatctttgtaactgca

SEQ ID NO: 2052 - protein, 368 aa, Homo sapiens
SGGGKMRLREPLLSGSAAMPGASLQRACRLLVAVCALHLGVTLVYYLAGRDLSRLPQLVGVSTPLQGGSNSAAAIGQSSGELRTGGARPPPPLGASSQPRPGGDSSPVVDSGPGPASNLTSVPVPHTTALSLPACPEESPLLVGPMLIEFNMPVDLELVAKQNPNVKMGGRYAPRDCVSPHKVAIIIPFRNRQEHLKYWLYYLHPVLQRQQLDYGIYVINQAGDTIFNRAKLLNVGFQEALKDYDYTCFVFSDVDLIPMNDHNAYRCFSQPRHISVAMDKFGFSLPYVQYFGGVSALSKQQFLTINGFPNNYWGWGGEDDDIFNRFDRIAHTKETMLSDGLNSLTYQVLDVQRYPLYTQITVDIGTPS

SEQ ID NO: 2053 - DNA, 23126 bp, Mus musculus
  misc_feature (1)...(23126): n = A,T,C or G
actgcccatcttcatgtgagccatgccattcctagcatgagttgctttgtgcttggactcactcactcttgctttctgcacattgtctctttgtaaactctctcttggcctgctcagttatcctaatttgtttaagaaaaacataatttcatcaccaaatggaattaatttaggtgaagttctagtctgattaacaagcaattgagcctagcggatcctgggcagccttggagatgggttcttttgttcaagggatggcacacagaaccaggaaatcctgcccttgtatagacacttctaggtccttcacgaccatgagaaaagttacagactccttttctgcggaaaaaatcacacatacgtctaatttaaattgcaagctcactgtggatgctggaagacagacagacagacagacagacagacacacagtgggggaagggtggagaagagacatgtgttcacgagtgattcagagcttggtgtttgtacagagagggcctagttaaggggtgtggatgcttagagggatagcagggatgttgaagaagagtgttgtcttctcagaaccatggttaggataggaaagaacctcctaggggatgtatggcctctaataggggccagaggcaatgagagctggtgcctgcctttctcctttttatctgcattgtctcctatggagcaaagccagctggtgccagacgactgactgggatgccattgcatgccattgctaccgtcatgagtattcagggaacagaggaacctggtgtctcagcttaggaattaaatacacacacttcaaagcaatctagaagttctgtgtttattttaatggtacctacaccgacaaatcacagtattgagggatacctgtctgttgttggaagtgaggatggccttctgttcatggataactcccctaaacactacttggatttttaaaaaaaaatgttagttgatacacacgtttagagtggttttaggccaattaaacagtgaccagaggggcttgggcaatggtttcatctgtgaagtacttatttcaaaagccagaggacttggttttgaatccttagaacctatatatggaactgggtgtgccagttcacgttggagactcttgttatgcagatagaggagggtacatgggtgatccctgtacaggcataccctatgtagcccaggctgccctcaaactagaaacatccctcatacattaatctccccagtactgaggtcataagcaggagtcacagtgcccacctctccttacatgtgcgtgcgtgtgcatgagtatgtatacatgcatatgtgtgtgtttatacatacatatatgtgagcatgcatgtacatgttcatgagggtacagacagatccctgaggctctacggccactcagcccaatggaataggtgagctccaaggtcaagtaagtaactctgcctccaaaaataaagtggagagtgattgagaaagacacctgtcctctgaatgtacacctacagacacatgtgcatatgtacatggacacacacaactacacagacacatgtacatgtacacagtacactgtgtccagtgagctccagtgatcctcctgtcttcaccccgagccccagtgttggactctgacacacctcgttttatgtggcttctgggaagccaaactcaggttctcatgctggcaacagcaaatgctttatccactgagccacctccccgtagcctgggttttgacaatggtctactgcctgctacctctggacagtatcacacagaatggattcacagttgcaagtatcctttgggctaaatctatttactccttcctcccctccaacctgtggcattcatagatcttatttattgtcccacactttgtttattctagaatgtctgaggctagagttataccggaagcagcctgttgagagcggcttctttcacttatcatcatgcactgaaggctccctgtgtctctttgtggcttgatagctcacgtctttttatttctgagtaatactcaactgtctagctgtacccgtgtttgtttattcttttgcatactaaagggtgtctcagccgcttctctgttttcaccgtgacaaaattaataattaataagcagatattaatcatctgtgtgcaagtttttgtttccagcccatcgtagaacgatgacctcttgcttctgagagtcccaggagaggacatgcagcatacaagggtcacattaggatcacaccctcatgtatcccagtccctcttagaatgagttttccaacagctccaaaagaggaaattatgcaggaatggaaagatctcaaagcctggagaccacactgggtggccaagctggtgactgtggtacaagatgaactgaaattaggtaacgctgtcatggaagccactacttctgcatccagttccttccaacacacttagcaactccatgggtccctccactgccccctcatgcatctcaccttggatgtgaattttgcaaactcatctgggctttatatttcatctctgccctggtcccctgaggggctggcttttctcactatcggaagctttgaaaatcaccattgctactttggtcctacgtgtcttctcatctctcctccataaaatctttgtgtatccagaaagccaaacgactttactggagaatgtgacccttcatgggcacacaactggcaggacagggatagaagccctgttttctgtgtgatagcctttgaaaggatcctttgacattgggtctaggtgactggacaatctaaactctgctcctccttcccataccgtcccctcaatcctcccatccatccaagtagggacggtacaactagcccttccttgattaaaatcagctgtgtcccatacagttcgccctggacaagagtgttggtctcccagttgaagggtatcatttgtttggtctcagcaggcatcagctatgattacagattagattcagacagccaagctggaagagcgcactgtttccaagggctgagcctcctacccatgacagtcagttccggctgagatttttgttctccccaataatgggcttgtttgctggagccacctgtcactgggcttcagctccccagctacctgctgggacacttccctcatgtagcttcttccccctctgcagggacacagctctgtaggaggatatcagggctgctggcttctcccaggcaaaggtctctgtgggctgtcttcccctcacttcaggacacttgctttttgcagactgcctggcatggggtcccacttacctctccctcaactccccatgaggcaggctgaggtgggaagtactcctcccttccttctggctcccctcccttccacttcctccccacccgcccactgggactatcagagaagtgctaggagctcagattctgctcattacacttccttccttaggattagggctcagaactcagatgtcttgactctgattctgccacagggacttcaacagaaaccttgcccgtcaaccctcagacaccatttcagagccaaccggggtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggaataccagacagagcctgaggtagtactcaggttccaggagacaatgtctcctgtagcagtctgaggcagtcagccccagatttgttggcactctgttcaatggccaaacctaaggggtgacacagccactgggcaacagtatactccactacagacagccttcctaattacctctccctgggagccacagtagagtcacatcccctgaatggaacttgaggggtgggtgaatggatgctgggggatgaagggagaggcaggggagggaagagccactggataatagttcaaaacattatactattttttaatgctattattgaaaacacagattaatcaagctcttctccatggtagatgcaggcataaattttttttcacataaattatttcacttaccagtcctggtggtacacatctgtaaacccagtatccagagcgctgggactggaggatggcaaattccaggccaacctggactccacagcaagaccttaactcaacaagaacaaagaaaaggaagaaaagagattgagttgggtgtggtggtacatgcctgtaatcccaaccatcaggagactttctaaacgtgttttgaggcggggtcttcctaggtagcttagacaaacctcaaccttgagatcctctcatctctgccgctctaatgcccatgcttatttaattacatgtatttatttgtgtacgtgtggacgtgcgtgtgacctgtgcgtatatggacatcaggggacattcgtgggagtcagttctcttcatccacatgtcagcctcagggatgaaattcaggttgtctgccttggcagccagggcccttacccactgagccaccttttaggtccccctcattttaaagttgagaatttgaactatcacattgagttctaaagagttctgtgtatgtacatgtctgtacatgtttgtgcccacatgtgtgcatgtgtaggaagaccagaggtcaacactgagtgtcttcctcaagttctttctgctcattaacttttattactttgaagtttttcatttattattactatgtgagtgcatgtatgtgagtgtgtgtctgtgagtgcttgtttgtgagtgtatatatgtgagtgcatgtatgtgagtgcatgtatgtgaatgaatgtatgtgagtgtttgtatggtggtgagtggtgtgcacatgccacagtgttgctgtagaggccagaagacaactgtatggagtcaattttttccttccacctttatgtgggtcctggggttcgtttctaaggcatggggcttgtgtagcaagcatctttactttctgagttgtgttgctgcccccctcagctttattgcgacagagctggagctcactggttcagctagagtgactggccatcaagctcagaggatctgtctgtctctgcctccccagcactgagactgcaggcatgcaccactgcacctggctttcacaacaggctctggggatccaaacccaggtctctgtgcctgtatggcacacacctaagcctcagtcttatgccctttctaccaccagatcttatacttcctcccattgtgtgtctcttcgctttcttgttagtgttcttaatacacacatgtcttactgagtcaaagttttctacttttccttttgctggctgtgcctttggcgtgtattttggagccactgccacatctgaagtccagatttaactctatgtcttctaagagtcttagagcttttgatctttcatttttgtctctgatctattttgaattattcctttgcatattacatgaagcagaggctttaatcttttgtgcatgtatatatgtaaggcctcaagttgtaaaacttaatagctaaaggggcttggtgagaaagtctggtgtcatgagttcaatcctggggactcacataaaagcagaaagacaattgattctgcaaagttgtcctctcagctttatgcacccacacacatcatgaacacatagtaataatagttttttaaaaacaatatatgtaactgtaatatcttttctttcaacataatctattttgtagcctatttttattttattttatttttttattgtctattttctttatttacatttcaaatgttatcccctttcctggtttccctccctcccagaaacaccctatcccatcctccctccccctgcttctatgagggtgttcctccacccacccacccactcctgcctccctgctctcgattcccctacactggggcatttatcaagccttcataggaccaagaacctctcctcccattaatgcatgacaaggccatcctctgctatatatgcagctggagccatgtgtactcctttgttgatggcttagtccctaggagttctggagcgtctggttagttgatattcttgtttttcctatggggttacaaactccttcagtcctttctctaactcctctattggggaccctgtgctcactccaatagtgggctgtgaacatttgcctctgtatttgtcaggatctggcaggggctctcagaaaacagccatgtcaggctcctttcagcatgcacttcttggcatctacaatagtgtctggttttagtaattgtatgtgggatgaatccccaagtggaacagtctctgctcaacactttacctccatatttgctcctgtgagtattttgttctccttctaagaaggaccaaagcacccacactttggtcttccttcttattgaacttcatgtggtctgtgaattgtatttggagcatttaggctaatatccacttatcagtgagttcacaccatgtgtgttcttttgcaattgggttacttcactcaggttgatattttctagttctatccatttgcctaagaacttcatgaattcatcgttttcaatagctgagtagtactccattgtgtaatgtgtaccacattttctgtatccattcctctgttgagggacatctgggttctttccagcttctggctattataaagtaaggctgctatgaacatagtgaaacatgagtccttattatatgttggagcatcttctgggtatatgcctaggagtggtatagctggttcctcaggtagtactgtctccaattttctgaggaactgccagactgatttccagagtggttgtacacttgcaatcccaccaacaatggaggagtgttcctctttctccacattctcactagaatctgctgtcacctgagtttttgattttagccattctgactgctgtgaggtggaatctcagggttgttttgatttgcatttccttgatgactatgaatattgaacatttctttaggtgcttctcagtcattcaatattcctcagttgaaaattctttgtttagctctgtaccccatttttaagggttatttggttctctggagtctaacttattgagttctttgaatgaattagatattagccctctatcggatgtaggattggcaaagatctttccccaatctgttggttgcctttttgtcctattgacagtgtcctttgccttacagaagctttgcaattttatgaggttccatttatcaattcctgatcttacagcataagccattagtgtcatgttcaggaattgttttcctctgtgtccatgtgttcgaggctcttccccactttctcctctataagtttcagtgtctctggttttacgtggtggtccttgataaacttggactcgagctttgtacaaggagataagaatggttctatttgcattcttctacatggtgaccaccagctgaaccagcaccatttgttaaaattgctatctttttttcccattggatagttttagctcctttgtcaaagatcaagtaaccatacatgtgtgggttcatttctggaacttccattttattccattgatattcctgcctgtctttgtaccaatatcatgcagtttttatcactattgctctgtaatacagcttgaggtcagggatagtgattcctccagaagttcttttattgttgagaatagtttttgctactctgggttttttgttactctaaatgaattggcaaattgctctttctacctctacgaagaattgatttggatggggattacattgactctgtagattgcttgtgcaggcttttactatattaatcctgccaattcctgagcatgggagatctttccatcttctgagatcttcttcaatttctttcttcagagacttgacgttcttgtcatacagatctttctttcacttgcttggttagagtcacagcaaggtatgtaatattatttgtgactattgtgaagggtgtcatttccctaatttctttctcagtctgtttatccttttgagtagaggaaggctattgatttgtttgagttaattttatttctggccactttgctgaagttgtttatcagctttaggagttctcttaaatctttggggtcacttaagtatacaatcatatcatctgcaaatagtgatattttgacttcttcctttccaatttgtatccctttgatctccttttgttgtctaattgcccttgctagaacttcaaatactatgttgaatggatagggagagagtgggcagccttgtctagtccctgattttagtgggattgcttcaagtttctctccatttagtttgatgttggctaatggtttgtagtatattgcttttactatgtttaggtaatggccttgaattcctgatatttccaagacttttaacatgaaggttgctgaattttgtcaaatgttttttctagcatgtaatgaaacaatcatatgtttttttcgttgagtttgtttatgtagtggattacattgatggatttccatatattgaaccattcctgcatccatgagatgaagcctacttgatcatggtaaatgatcattttgatgtattcttggatttggttggcaagaattttattgcgtattttttcatagcctatttataaaatttccttttctttttcaatttcttaaaatatggcattgctatgtagcccaggctggcctggaactcataatcttcctgcttcagcccccaactgctgggattccaggcatgcactattacatctaccacaatttgcctttaagtgaggctatgatttgcatctggctcacagacttgctgggaaatccaacagcagttctcttgagcagcacttgctccccagtggccttgttacccagtgtggtgatgctgggaaggagcacagataacctgctgaagaccgcagttttcaggttccttgagggaaacttgagtttccagtgagtggtacaatgtgcacacaagcttaggtgggggggggggtgtcaccagcctactggaagtcatctgactttcccttcatgatttgagaatgaatgtagcctggtagtggtctatctgctcctcctggaataccagcaactgacttaatctcaattgtatcaggtagggatttgagtacagacctaggcttcatcctgaagttggatgagaactccttggaatgccatgacaccaaataaaggattcccatttatatttgaacttgacaacatcgtaatgttttagcatagacacaactctttgggtgcagggacaagcttatattatgagaattttccatgtaatatttgggccaagcttccatgcattcagaggatgatgcacaatttttatgaaattcaaatttgtctcacagccttgcattttagtttcataatctaggaagctccaccctaaccctagcccaccaaggtcggttcttactgtagtcctcctgatcaaagactcggaacgtctgagtgagaagggccttactctggacatctcatagatcttgcatcctgggcaagaaagggatttgaacttgctggagtagtcagtgtggatgttaaccacctcaatggggtgctcacctgtgtgtgtgtgtgtgtgtgtgtgtgtgtgtgtgtgtggccctgttgaatgctactcaagtgttctattactgagctacatccctagctctttttgtatgttttattttgagacagggtctcactctgtcatctaactagaacctgtaatcctcctgcctcagtcccttgaatagctaggcttacagtttggcaacaccataccttccttaactgagtggtgggggattgttgtttgggttcacagagggtactataataccttctattggggagaagagagaccccatagtaagtgtggttctcactcacaggttgacataatcctggaccacgcagatgatgaggaatggaggcgtcagaaccgacccaccctaccccatcggccacggaccagccagcctctgtacccggcattccagggggcctaggggggcaggcctcacctcgcctgaccctgggtcctgttatcctgccaccagagcagggcctggccccaactgtgttcttgaaggcattgcctgtccccttataccacacggtacctcctgggggcctccagccacgtgcacccctggtgacaggcagcctggagggggccagcgtacctttcattctcagccccttgctgcagcctgaaggacccagtgccacccaggtgggcaagccagccacccccgccctgactgtgaacattgtaggcacattgcctgtactctcctcgggtgtggggtctgcactggtcagcacaggcagagtgaagaatactggtaagtacctgtgcccccactgtggccgggactgcttgaagcccagtgtgctggagaaacacatccggtcccacacaggtgaaaggcccttcccgtgccctacctgtggcatcgcctttaagacccagagcaacctgtataaacacaggcggacacaaacacatctcaacaactcccgcttgtccttggagtctgaggggagtgggagcagccttctggaggagggagacaggcccggagagaccgcctcagtggatagtcgtggagatgaaggtgctccagagagagccctttccccaggtgccctccccgcccttgctgctcagaacagggaaaggaaggtggaatcggctccctctctcggggccaccctttcccacagggaggcctctgcggatcacactcagatggtgtcacctgagttttcactagccagcccgcagcctaggcggaagctgccagaaccaaagccatgcttcctgcagcgacagcaggagacctgttcagagaagccctgggaccccaaggccttggagggccagctgaggaagtgtgagagcacagactctggctacctgtcgcgctcagacagcgtggagcagccccctgttgcctctagcccattgcatagtctatcggagcacagtgcggagtctgagggggaaggaggccctggctgttcctcttccggcaacagggctgaacgaggaaccccagggcccagcctggagttagagaagaagaaactggaggaacgaattgcccagctcatctcccacaaccaggcggtggtagatgacccacagttggaccatgtgcggccccgcaagactgtgctgtccaagcagggcagcatcgacctgcccatgccatatacctacaaggattccttccactttgacatccgggctctggagcccagccgcaggagggctgccctcagcccggcccgctccaccttcacacccctggaaaaggccagacctctctttttccactcagtccccacgcagctctccactacagtggagtgtgtccctgtcaccagaagcaactcgctgcctttcgtcgagggttctaagttgtggccagagcaacgggacccacaggatgctgtcccaggaatgcagaaggccctgagccccaggcccaccccagcccggctgggatgccgcccaggactgaccttggcaagcatctccagtggtcacccacgggccctggtaagacaggctgctgtggaggacctgccgtgtaccccgactggagacccttcagccgctgctgaggaactagatggaaagagagctgtggcaaaggagggtgtggtgtacaagggcagagccagtaaaaagtgtagccagaggaagcaaaggatgttctcccaggagaaatggcaagtgtatggaaatgagactttcaagagaatataccagaaaatgaagaccaaccaccagggaggacagaaacacaggcaggtgaaacagggccaggggacagaactggactttcctcctcctcctcctcctcagaaacaggggggaggaggtgaggatacaggcctgtctcaagacagtaggatccctatccttggagacactacagcaggatgtaagctagagtcttggggaagtagaccatccctggaagactcactggaggctgagtctcctaagcaactgaaggtggtgaccagagtcaaatcatctcctaccctcggcagcacagatagcctctgtttgagtggcaagagctctttgctctctccaagtgggaaattagatctgggatgccagccgcctccggtgcctacggcttgccaagcaggagatttagaagctcccgagactgcttcaccagactcaagtggtgaggctataaaagaaaccagccctggagcccaaaccgtcctcagacggtccagtgatgggtctgtggctctacagcttgcagaagacaagttaccttcagagaggaagagactgaaggtggaagggctggaccatcaggagcagccagggcctctggaagctgatacctcaggaggctctgtgcaggctgaccccccaccgtccgagagacaggacagtgactctgaggagttgctgggttgctcaaataagagtaccctgcatgtgaccacagccccggagccctcagatgtctcctcagccgcttctcctgttgccctgcaatggccagggataggggacaaggattccccattgccttctgtacccaggactcctgggcttcactccctcttgcctgctcagccccaggatcctggtgtccctaatgctcggtcaggtggcttctttcctcccaagtacctcctcaggttacctcagggagagaacccctcaccgatagttgctgcagggcctgaaaaaggctcagactctctgtgtacaagtacacagcctgtagaacaggcccttctggttggatcagaactcggaatgctccggccacctggtgcatactcaggcccaggtgaggcaggtggcagcccagacgaccctagctggtccaggttaagggatggaaaagaagaggcacagacaggaagagagaaaagagataggaccaaggacaacatcctagtggttgggcactctcctgttccaattaccagcaccacccaggagatagcctccgttctgtctactcacacctgtgacattcgggtggcccaggatgtagtgagtaagacccatgccatccattgcctctgcacagacagcccaccagcaagagctaggacatatgggaatctcttaaacccttggacatcatcccagaagctggggataccgcccaagagtgccctagaaggtcctccttcagaaaccaaggaagggctgcctgctttcttttcctctcaagcacactatttccttacaacttttacaaaaccccaggatatttccttgaaccagcagaaaccggccttgtcacacgtcttaggaacccccaggagctgtgaggccccaagctccttcccctcacttaagactgaaccccagctcacatggtgttgcttaagtcgaagcctgcccctgcctgcagagcagcggaggatagctcctggacacttggcttcatccttgcctaatagaaacctccagggcgacagtaacaaaacactacccaagagcaatggaggaaggacccagacaagccaaggaggagaagtgtctacacaggcgcctgaggtaacaccagcttgtcctggggacagggtcagcatgacagtgagacacgaagaacaagagagagggagaggagagagagagagctcctgaatctatccttgtggatatcacctcccattaggaggtcctctgctgccaagagaggctagcgctgtcatacatgggctgggaaaaaataaaggccctagatatgaacaaaactaaacaaattcatgaaaataacatagtaaaaaactattctactagagtctgagtcatagctgagttggtaaagtacttgccatacaaccatgagggccagagaatccacaattaaaaagccaagtaggatggcaggccattctaaccccagcactggggagatggtctctgggggcttagattagcctagccagtgagtctcagaccagtgggagaccctggctcaaaatataagctggatggcttctgagaaatgacactcaagattgttctctagcctccacatgtgtgtgtacatgcacacatacacacacatatgcacacacactacacctgagacttgaaagcattcttgcttctctccagggactaagggtgaggatccaaggtgtgatttaaatcttccccttcgaaattgtagggattcctgagtggtagaactatggatgatggttaattctccactcacatcaaaggtccagcatttccactggaaatccagctaggtatagttctggatggttccatgtgacacattaccagttgcctggtaagagtactgaacaggctcagactatttagtaacaacattttggtgtcttaatttctatagaataggcatcctgtctgttgagaaagagcccatcatggtggtccccaccatgagggctttgagtgacatgatgccaacatgcctggtattttcagcttccctatccatcagtcccagagctgagggctgaggaccaagtatccaggccacggtggaagaaagaacaactatggcgtagaaaggtgaagacatctcgtgaaaacaccaaacagaagaaactgaggcttcattctaaaaggtaagatatgtggcctccccttccccttccctgctagcctagtatgaggagctgcaaatggctacttagccaaaccctcaagaactgaatgtggcattaaatggcagattagctccagagagaggctcctattctattggtctggaattctgaagctccagatctgcctctgttgcccatagcccatccagcatgatcctattgaccatgtaattgcttactggtatatttctaagacagaacacagtaaatatttgagataaccaagttgaaaatccatccatccatccatctatccatccatccatccatccatccatccatccatccatccatctatccaatgataagagagtatgtgttaattattgcttttcagacttttttttttttttagtatttgcaagaaatgtgtatttttgcagaaaaaaaaatccagagaagcaaagagaatgctttcagcaatcccaaggcttggggatattcttctaaacattcagaggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtggccacagctgggccagagacaggtagtagccaccctgaataggtaagagctgttttttgaatatcccagttccctacctcttcttcagtactggatccctccagctatgtttctcagctatcttacatgcctatctccacagacaattaaatttgaagatctttatcttaatagttgaccttgagggaatcaagagagggcatctttatcaagaaagtgctttaaaagatcctcaaagttgaatatgtggagttgggcacaggggagcaaggaagctctgtacaaggtccttgtcctagttaccttttaattgcttgataaaacaccatgaccaaggcaacttataaaaacttataaaaaaaaagtacctaatgtatatatatatacatacatatatatatgtatatatatgtatatatataatgtatcacattcgtccatctatctatctatctatctatctatctatctatctatctatctatctatctatctagttgtccactatccatcttcctgacattgttgtgaggtattacattatgtgaatgaggctcacccttctttgatgcttgttaatgttagctgttttgaatcttcaaatgatgaatataatatataggatcctgtgagagtctagatagtatagattctttacatgttaaaagctgtgtatacattcttctgtctagcatttagtttttaaagccattttattcatcttggcctatggaattgacccatatttcatttctgaatgcattttggatcatccttctagtattttcttcagaattcctgcagaaaagaatactgccctggctgtcatcagtttgaaatagctgcattcatcctggtgttgggcagtatttcttctggctacagggctctagataaacattcctcttttgcttgggcatcaaggctcttcttccaccatctttagtttctgttttgttgaaatctgccatttgccacttctctgtctgtggaatgtctttaggtttggttgctgctaaagctgtttctttagtgtttgtgtttcaccactttactgtgacacttggagatagaggttacactttatgtagcccatccagaatctgctgggctttgatgatcttcctagaaaatcctttgcccatcatttctcaagcaccatttccaccccactctctcctttccttcgaaacacagaaaagtaatgtttcttagactttttcttctgtgtgtgtgtgtgtgtgtgtgtgtgtgtgtatgcatgttcttgtgtgtggtacatgtgtatgaacattcacatatatgctggtgcatatgaaggccagagatatatatcaggtctgttctcagcttcactttatttttgaggcaggctttcttactggcctgtaccttgcccaggcttctcctcatgtgtgcttccccagagctcagattacaagtgcatattattattcctgtttgttctttggttttgtatgtgtgtcctgggattacagctcaggtatttgcacagcacaggtcttcatgtttgttcaacaagcactttgccaactgagacatctctccaacttttttttttcttttttaaaacagggtcttactgtgtagcccaagttggcctgcactggtgattctcctgcctcagcctcctgaatatggtcttacagaatgcaccaccagacccaacttgcatgtcttctacctttaataattttggtgtctctatggctacacaatgagtggtatacttaaaattttactaatttccttaattcattaaataacttctctgttgaagctttattaatgtataattgagttttaataaattgcatatctttaagacatgtaattgaattaattttgacataaattcgtaggatgccaaaggtagaaagtctccatcatgtctttataattcctctcttctcttcaacctgcctctccttttcccagtgaactttaatatgcttctatcaacgtagatttgattgcttcttctagactacaagagaaacaaactcactctctctgtgtgggagttgctcttctctggggttagctctcccagacaccttgattatcttgggactcatcgattcactgggtttaatttctgatgctataataaaacatgataaaaaatgccaaaaatcatcttaagggctaaagaatttatttcagttcacagttccaagttatagtctcttgtagcagggatgtgaaggctacagtaacttgaagcagtgctcacatgactgtcacctgacacccaccttcaagggcagagagaaaggaatgcatgctccctcactgctcacttgcttgcttgtgctggcttagcttgagtttttcactcttacacagccctggactcaacaccaggaagtgatgtccactctgggctgggtcttcccaggtcaattaacataagataatcccacatagactgagtctccagtcaacctgacctaattaattaattcctcattgtgattctcttcctaggttattttagggtgtattgagttgccagttaaaggcgaccaccacatccatgttgtatgcataaacactttaccccttcttgatcgattcatatgactgaggacggctggggttcagctcatgtttaggtagtcatatcggtgaaagtttcagaagctaaacccatggagtctcaactacatgactgactaaatatttttaggtttgttttttttttttaaagacaagtgccctctgaatgtgggactgtgggtatgtgctgccatgcctagcccaaataattctcttatttacttatttagattcttgggattaaatccatacaaatgccaggcaaatgctccacactgtgctacatcctaattaccagtttttatttccctcatgctatatcttaaagagtaatcatcttcaattttgacgaaatgcattttcttcctttccccttttcgttgtgttttctctcagtgtaaaatatctgaagtttctttctgaccaaatcacacatttctcctaccaccctgtacctcaggctccacacctgagcctgggatccatgttcacttcgctctatggtatgagttatggattgaagctcagagttttgcaggtagccatgtgctagccctaacatgatttatttgtctgttttgatgcaaatatcacaccattttgattataacacttaaaccgaagagattctatgtgaggctggtgaattcaaagcagcatggtacttctaccaggatagacagagactgattagagagaccaggaggtgaagagggacttttgataagttttaaaggaaaatcagtggggaaaaggagaagggactgtctttccagccaacagtgcccagcctggaaagcagaaggaagctttaggtggcgatctcgtcggattctgctctaaggagcagcaactttatcccacagtgcctgtcagtccatacattgtccagactgtaagtcaaattaatcatttctcatctccaccagaggtctgtagcctcccatagcggtttcctattcattgacatcctgtctttactggtctgaccttttaaacagttttattacatttatttgtttgtttgtatgttctgtgtttaggtcagaggacaatgttcgaggcagggtttcttattccactgtgtgtgtcctggagatggagcttaggtgattaggtttagtagcaacacctttacccattgagagagtttcactaatctttaaatgtagttgttcctggatattaccttttatctgcaagaagcacatacatacagaatatgtcccctcatccttagaggtggggtctcactgcacctggagcttgtgaattcagcttggctgtctggcctccttccatgtccaactccccagcatgggcatagcaggctcccacaatttggcttttgtgctcatgttgaggatctgaactgtttagcatggcagataccttgttgacttagccatctctccaggccctcagttctttaaaaaccacacgttagagtttgcacttgatgatcccagcagttaaagtccctcatgcctgcctctgtttacatattaattctcacttacagcaactgagtgccctgtgctcgtgatatgggaacactgagatctgggctgaaagcacacctcttggagtggagtggagacgacttgttttgcttctactaactctgctaggctctagtctaagagaagctcttgaagttaaggttttcctggtgtcagcccacaggaatcagggaaggtctcttctgtttatggaaccaactggaaggatttcttctcattcccgggggggggggtgtgggctgggggcactcacttttcagtcacaagcgtggtaagtgcatggcttgccaggggcctgaggtctctgcaacaataagaactccccccttgacatccactaaggtcctgtcccacccagctaggggacatatacaggaattacctggtctggagaaaccattgagatgaaaacagatttacctgctcaggttttcttcctttacaatgttaatggttttgtaccttccaaccagactatcaatacttttaaatctatttaatttttaacaacaacttaacttgtagttcagttggttttggtaaggagggctgtaatgggaccacagtgttaggtgagggctctgaacccaggagatccggctagaatttatttgctgtgtgccttcttgttaagaagttgttttaattcctaatatttttgaagctctgactttgctaattcgatcaagccaatctagacttttgatggggttcttaagcgctcagcatctgtgtgagaagttgcccacttcaatgtatccacgaagctgccttttcttcttcagttactcagtgatggtctgtcaaggaagtctttcctaattcagtctcccaatgtcatgagcaaataaagacttcctctgatacctttctaacatacataagtatacacagtcatatatatgtagaaggatttggttttatttttgtgatttagacaaccagggagcatggatcaaatgtgattttttttaaatttgttttatctagttataacataatgtttttgaaactgcatatatgctattagattacacatacacatttcacatatagagattttatttgattggaaaactctaaaacataatgtagaatttacatcagaatcaagggtccctcagctgtttgctgtttttagctccccgtttacactcaaagttcatttcggggcctttccgttcggtttcatttctctctccctctctctatcccagtgctgtgatgagaatggttccattaatgacaccgctcacgttaaaagaaagggagtcgaaaatacggggtccattttgagagcggtaatggaaacatgttgaagcttcttgctggcatgactaattacttagatgttaactcgaggcacagagattcacaaagttctcggaatacatctgtgccaggcccacagcaagcactggaccgtggaattgggttttgttgattaatttgtggctgtgtacaagcatgaagcgctcagagacttggctgaggaagcatccaggaagtgctaaatagatagcccccacagaggggagatgacaggtgtgtgtgtgtgtgtgtgtgtgtgtgtgtgtgtgtagggggctcagtcctaaagggcacacttggccctgaggacaggattctagtcatcatgaaggtctaccttgtgcatttgctattcttgtcttcagtcaagatggaatttactcagttgagaagtctgtgaggtaagatccacagtcaggtggacagtgggtctgagctcaggtggcctttgctgcctatgccccaccccacacgtgactgagaccctgtgacccgttggccacagccctagggctttgagcatggtcacagacacctctcagcttctctatgctttgacatgtccttagagccatgaacggaactgggagaaacagcaggacctagctctcccttggatgagcacgtctgaggccggcctgttcacccacttgccaggcctctccttagatctcactacagcagtatgttagagcaacagcagggctgatacatttcagctcgtcaagactcatgtcagtaacctcagccctcccagctcctgagtgaaccaaggacctccactccaaactgaagtccacaggctcatgatcttaacctagcagtcttcaggaatccctgatgcactgacctgggcaagaaacgctcactgtgactggtctccatgagaccaaggagcacagctatcctgaagcacatggcgaggacccagaggaagcagaaaggagtcttgcgtggagcctatggttcaaaatccgaaggggctgctttttaaaagtatgaaggagaaaatgggtcagcccagtgtcacagactagatgtgaacttagaaaactaagttgatctcaaactcagccttgaataggcagaagaacagggagtgagggaacaggccttgcatcatgtactaagtagatatgcacgtaggactgtgtgcatagcctcggtccttcaaaccagagcaagcatcctgagagcaacacccacgccaacacctgctggattctttagaaagtggggcttgggttgtaagtgagctcttaggacgaggctgtgaagagccagctgaaggcagggaaaggggtgtagagacacttaaggagtctggcctcagcctgggccctcaggacctctgaagtgggacttgtactgtacagatcatcctactttgaggtaaacatgtctgaaccacggtgcccccacaccagccagtcaggtgggaagtttcccaggtacgcacaagcaagtcaaagtccccgctggaccagagggtatgcacatccccaacgcagtggtagagatgggtagccccagggagaactgttagatggaacttcacagaacctggcatgccttagggttccctgaatgacagcagatgaaaaactgcctaaccaggtttttttttttttatgcagttgcatgtggggaggtaggggccctacacatagactcctctgaaaggattaagagagatggggacagctccagcccaaggctaaacaaagtatatatacaggttctccccaagtatgatagggtccagatcccactttgataaggagggccaggaactctactgacagaccctctcacccctttgattgaatgtagtctccaaggttcaggatgtgtgctgttcataaagactgcaagccagctgcagtgaccagtggtcttgggggcaaaggtgagcctgcatacttactggctgggtgacccccacaggtcccacctcccttctttcttttgtgtgctttgaaatcactcagcaggagctccagtgggctcagggggttatgatgagtgaagtagcagcctgccttccctcccctgatagctcttcggataaatcttgacaaatgggacagtggcttcagagctatcccctccaccctgaccccagaggatgacagctcctggtccaggctgggaaggcaagtttcttcaaatgtagacacccagtgaagaacaaaaaaacactctctcacggctggtgccaagagaaggcaacaccctagggcatgctgctgtgtgttgtttttcagtcctgatttaaaattcctagtcagccctggtggttgggtcttggaggaagctcaaacacaaggaagaagactaagcatgctgcctttccccaagaaggttctgtggggcttcatgggagtcaagtgcttggaaactgaagcccata

SEQ ID NO: 2054 - DNA, 3066 bp, Mus musculus
atggaggcgtcagaaccgacccaccctaccccatcggccacggaccagccagcctctgtacccggcattccagggggcctaggggggcaggcctcacctcgcctgaccctgggtcctgttatcctgccaccagagcagggcctggccccaactgtgttcttgaaggcattgcctgtccccttataccacacggtacctcctgggggcctccagccacgtgcacccctggtgacaggcagcctggagggggccagcgtacctttcattctcagccccttgctgcagcctgaaggacccagtgccacccaggtgggcaagccagccacccccgccctgactgtgaacattgtaggcacattgcctgtactctcctcgggtgtggggtctgcactggtcagcacaggcagagtgaagaatactggtaagtacctgtgcccccactgtggccgggactgcttgaagcccagtgtgctggagaaacacatccggtcccacacaggtgaaaggcccttcccgtgccctacctgtggcatcgcctttaagacccagagcaacctgtataaacacaggcggacacaaacacatctcaacaactcccgcttgtccttggagtctgaggggagtgggagcagccttctggaggagggagacaggcccggagagaccgcctcagtggatagtcgtggagatgaaggtgctccagagagagccctttccccaggtgccctccccgcccttgctgctcagaacagggaaaggaaggtggaatcggctccctctctcggggccaccctttcccacagggaggcctctgcggatcacactcagatggtgtcacctgagttttcactagccagcccgcagcctaggcggaagctgccagaaccaaagccatgcttcctgcagcgacagcaggagacctgttcagagaagccctgggaccccaaggccttggagggccagctgaggaagtgtgagagcacagactctggctacctgtcgcgctcagacagcgtggagcagccccctgttgcctctagcccattgcatagtctatcggagcacagtgcggagtctgagggggaaggaggccctggctgttcctcttccggcaacagggctgaacgaggaaccccagggcccagcctggagttagagaagaagaaactggaggaacgaattgcccagctcatctcccacaaccaggcggtggtagatgacccacagttggaccatgtgcggccccgcaagactgtgctgtccaagcagggcagcatcgacctgcccatgccatatacctacaaggattccttccactttgacatccgggctctggagcccagccgcaggagggctgccctcagcccggcccgctccaccttcacacccctggaaaaggccagacctctctttttccactcagtccccacgcagctctccactacagtggagtgtgtccctgtcaccagaagcaactcgctgcctttcgtcgagggttctaagttgtggccagagcaacgggacccacaggatgctgtcccaggaatgcagaaggccctgagccccaggcccaccccagcccggctgggatgccgcccaggactgaccttggcaagcatctccagtggtcacccacgggccctggtaagacaggctgctgtggaggacctgccgtgtaccccgactggagacccttcagccgctgctgaggaactagatggaaagagagctgtggcaaaggagggtgtggtgtacaagggcagagccagtaaaaagtgtagccagaggaagcaaaggatgttctcccaggagaaatggcaagtgtatggaaatgagactttcaagagaatataccagaaaatgaagaccaaccaccagggaggacagaaacacaggcaggggggaggaggtgaggatacaggcctgtctcaagacagtaggatccctatccttggagacactacagcaggatgtaagctagagtcttggggaagtagaccatccctggaagactcactggaggctgagtctcctaagcaactgaaggtggtgaccagagtcaaatcatctcctaccctcggcagcacagatagcctctgtttgagtggcaagagctctttgctctctccaagtgggaaattagatctgggatgccagccgcctccggtgcctacggcttgccaagcaggagatttagaagctcccgagactgcttcaccagactcaagtggtgaggctataaaagaaaccagccctggagcccaaaccgtcctcagacggtccagtgatgggtctgtggctctacagcttgcagaagacaagttaccttcagagaggaagagactgaaggtggaagggctggaccatcaggagcagccagggcctctggaagctgatacctcaggaggctctgtgcaggctgaccccccaccgtccgagagacaggacagtgactctgaggagttgctgggttgctcaaataagagtaccctgcatgtgaccacagccccggagccctcagatgtctcctcagccgcttctcctgttgccctgcaatggccagggataggggacaaggattccccattgccttctgtacccaggactcctgggcttcactccctcttgcctgctcagccccaggatcctggtgtccctaatgctcggtcaggtggcttctttcctcccaagtacctcctcaggttacctcagggagagaacccctcaccgatagttgctgcagggcctgaaaaaggctcagactctctgtgtacaagtacacagcctgtagaacaggcccttctggttggatcagaactcggaatgctccggccacctggtgcatactcaggcccaggtgaggcaggtggcagcccagacgaccctagctggtccaggttaagggatggaaaagaagaggcacagacaggaagagagaaaagagataggaccaaggacaacatcctagtggttgggcactctcctgttccaattaccagcaccacccaggagatagcctccgttctgtctactcacacctgtgacattcgggtggcccaggatgta

SEQ ID NO: 2055 - protein, 1022 aa, Mus musculus
MEASEPTHPTPSATDQPASVPGIPGGLGGQASPRLTLGPVILPPEQGLAPTVFLKALPVPLYHTVPPGGLQPRAPLVTGSLEGASVPFILSPLLQPEGPSATQVGKPATPALTVNIVGTLPVLSSGVGSALVSTGRVKNTGKYLCPHCGRDCLKPSVLEKHIRSHTGERPFPCPTCGIAFKTQSNLYKHRRTQTHLNNSRLSLESEGSGSSLLEEGDRPGETASVDSRGDEGAPERALSPGALPALAAQNRERKVESAPSLGATLSHREASADHTQMVSPEFSLASPQPRRKLPEPKPCFLQRQQETCSEKPWDPKALEGQLRKCESTDSGYLSRSDSVEQPPVASSPLHSLSEHSAESEGEGGPGCSSSGNRAERGTPGPSLELEKKKLEERIAQLISHNQAVVDDPQLDHVRPRKTVLSKQGSIDLPMPYTYKDSFHFDIRALEPSRRRAALSPARSTFTPLEKARPLFFHSVPTQLSTTVECVPVTRSNSLPFVEGSKLWPEQRDPQDAVPGMQKALSPRPTPARLGCRPGLTLASISSGHPRALVRQAAVEDLPCTPTGDPSAAAEELDGKRAVAKEGVVYKGRASKKCSQRKQRMFSQEKWQVYGNETFKRIYQKMKTNHQGGQKHRQGGGGEDTGLSQDSRIPILGDTTAGCKLESWGSRPSLEDSLEAESPKQLKVVTRVKSSPTLGSTDSLCLSGKSSLLSPSGKLDLGCQPPPVPTACQAGDLEAPETASPDSSGEAIKETSPGAQTVLRRSSDGSVALQLAEDKLPSERKRLKVEGLDHQEQPGPLEADTSGGSVQADPPPSERQDSDSEELLGCSNKSTLHVTTAPEPSDVSSAASPVALQWPGIGDKDSPLPSVPRTPGLHSLLPAQPQDPGVPNARSGGFFPPKYLLRLPQGENPSPIVAAGPEKGSDSLCTSTQPVEQALLVGSELGMLRPPGAYSGPGEAGGSPDDPSWSRLRDGKEEAQTGREKRDRTKDNILVVGHSPVPITSTTQEIASVLSTHTCDIRVAQDV

SEQ ID NO: 2056 - DNA, 24990 bp, Homo sapiens
agccttgtcagcatgtgttgtttcctgactttttaataattgccattctaactggcacgagatggtatctcattgtggttttgatttgcatttctctaatgaccagtgatgatgatctttttttcatatgtttgttggccgcataaattgttttcttttgagaagtatctgttcatatccttcgcccactttttgatggggttgttttcctcttgtaaatttgtctaagttccttgtagattctagatattagacctttgtcagatgagtagcttgcaaaaattttctcccattctgtaggttgcctgttcaccctgatgatagcttctgttgttgtgcagaagctctttagtttgattagatcccatttgtcaattttggcttttgttgcaattgcttttggtgttttagtcataaagtctttgcccatgcctgtgtcctgaatggtattgcctaggttttcttctagggtttttatggttttgggttttacatttaagtctttaatccatcttaatttttgtataatgtgtaaggaaggggtccagtttctgctttttgcatatggctagccagttttcccagcaccatttaataaatagggaatcctttccccattgcttatttttgtcaggtttgtcgaagatcagatggttgtagatgtgtggtgttatttctgaggtctctgttctgttcccttggtctatatatctgttttggtaccagtaccatgctgttttggttactgtagccttgtagtatagtttttctcattctgtgaagaaagtcactggtagcttgatgggaataacattgaatctataaattactttgggcagtatggccatcttcatgatattaatttttcctttccatgagcatggaatgtttttccatttgtttgtgtcctctcctatttccttgagcagtggtttgtagttctccttgaagaggtcctttatgccaatcttattctgcatgccagcccaggcttccctgttctctctgtctttcttcactggaaggaatatacttctcaactccttgatcttgggtgaatccctccatctctcagcgccttattcctcttgttagattaataacagcacctccctgctgcgtggattagatggcttagggcatgtgtagaccttgggcctgtggcctggacatggtgtcacataaaggtcagctccctgtgctgtgaacctgcaaagcttaggcagaagatgtctcaggcagatcaaggtaatactgatgggcttgggaaaaagaaaaagagaaaattagctgaataattttcagcagatttttcccattttgcattatgctgtgatcagtgcttataggtagcatctgtttaatcctcgttatccacattttacaaatgaaaatcctgaggttagggaacttgctgagcttcacagggagggggtaagtggcaaaaccagaactcaaacccaggcttttttcttcttccaccaagaagacaggggacggggatggctgagcgcagctggcaggccctccctcttgccaaagccaacctgacatcaagcttctccttccacacatctgcaaccgattgaccatctacagggaaaccacgtaatttgtgtatgaaaattaggcaattgcaggggacactcctctcctccaacttgcctaagctttctgcacactgtgtgtttgtttgtaaactctcttctggcctgctcctttatcataattgtttaggcaaaacatattttgtcactaaacagaatgaatttgggtgaagtcatagtgggaactaacatgtgtttggccctgacaggaagtgggcagcctcccctgcttttagggaggcgttgtttctaaccagctattctcaccctcagagacccttccagacccttctagaatctgacaaaagttagggctgctcttgctctctgggaacattcacctgcgcacataaggtaagttgtaatttccctttgggtcctggctggcctagatgcacattcaagtgggtgggcgactgagaggggtttcaatgtggggccatttaccaagtgtgggcctggttctgggaagttggggcacctgagggctggcagcagtgggggagtgttacccactccaggcatgagaggccaacgtgggaaccgtggttggacctagagagggccacctaacgaaagtctgtccctgagtagagggacaaaggccaccttggagccaggcctgaccttaccctcctgcctggacttgccagcacctccctttgggcaagcctagctgggtgctagtggactagggagcatgttgctgcagccttgcaggtacagggtctacaccaagggtgtatcaggtgaagactgtaagttaggcaggtgcttttcaaagtagaggaccataccactcaggtgtgcgagagcatgcatggtggcctacagatacatatttgaaaaattttaataggtatttatgttaatggttcgtagggaaaattgatcttctctttttggtgatgattgattcagtatccccaccgcccgcttttatgcccaattattacaagtatttatttcttttggccccctcgttcctgcagtaggcaaaacatgacatcatggtttataccttgcatttcttggctgatgaggataactatcttttcacatctcttttaaaaaactgttttgatttaaaacaattttcgaagttaatagacaatttttaagagtagttttaggtttgcagaaaaatgaggagaaagtacagagacctcccatccacctctttcagcctgtgtccccactgttttccctgttgtgagcatcttgcaaatgagggtggtgcattggttgcaactggtgaacccactgagagacaccaaagtccatagtctacactagggttctctcttggtattgcatgttccatgagttttgacaaatgtatagtggcaagtatttggtattacaggatcagaacaatccctttcactccacccacctcttcatcccctcctcccccaacccctggcaacccctgaccttttcactgtctccatagttttgccttttccagaaggtcatacagttggaaccacacaagacaaagtcttttcagattggcttctttcacttaggaacatgcatttaagtttcctctctgtctttctgtggcttgccagcttatttgctagcttatttctttttatcgatgaataatattccattgtctggatgtgtgtttactgatgtttactgaaggacatcttgctcacgtccaggtttttgcaattacaatgctgatgtttacatcagtgtgcaggtttttgtgtgaatgtcagttttcaactcactgggcaatgatatagttcctcttcctccctcccccctttttttttactttctgaaaattgcgatacaacatacataaaatataacactttcaccattgtgaagcatacagttcagtggcatgaagtgcattcacattgcatgcatcccttttaaagcaatggtgttctaggcatgaggctctacacaggtagggtggggactgagtaacagcgtaagtggtccccatacgtggcggagtgggtgatggtggtccaggatgaacggaagtttgggaaacttgtaactacaccagccatcttagtacccaagttctatctgctaaacgtatccaatatgcttctccatggccttctctttcggggccctaaatgtaaattctaaaaacctacttatggcattttcatgttctctctttgcccaggctcatttgtggtttgcttttgcaaaggagggcttgggaaattgtcacttcttctcttcaagtttctcccacctctttgttcccctctcctccataaagctgcacatttgcgccaaaagatataactgtttgtgggggggaattgggaggaggtggggagctgcacacgcggcagatgagggatgcgccaagttccctgcgtgtgggagcctggggatggcaacagggtgagggcttggcattcagtccaggtgaccaaggggctgtcccggacccttccctcgctcaaagaggtaagccttctagcgagctgctttcccagccccggcccccagcttccccatcagtccaatggggacaataggacttgccatctccttgattcagagtgagcaaaattatctgcagctttttgaggttttcctgagaaaagcgtcatctccctcgaggaaggtgttagtcagctgtcatcttgccagcagggatcagctgttactcaaaggcgtcaatttcgcagtgatcacagaacaggctgcagagagcacaaaatgatcatcgtggcaggtgtgtcggaaacatagcgctcttttcctggcatttctactttgaagccccaagcctcccaccctatgagagtcagttctgggctccttttcctcctccccctacccccaggttgggctaaagtttttggggggcacatgatactcagccctcagctccccaggcaggcccccactgagacacccctcgggtgacaaccccctcaatttggccccattttcccagtcacttcagggcctttctgggtgctctgaaattcgtcctgcagcgagagctctgcgtgtgcctcgtcctcctgcctggacgcacactccgggctgttgatgctctgtgtcctggcacccctctttccagactgccctggggaatggagcaggaattgccactgaggcaggagctggacggacttatttctcccttcctcccttccgtgacctccccacccatgaccattataaccgggggatcaggacaggaggcttgtactcatccagtttccttagggtttggggcttttggaattaaaacgcctttactgagtttctgccacaggaagacagaagccctgctcacctattctccgactcagcatttaagagccaactgcaggcagtgcttctgtgtctgatggctccctgtggccacagagcctaccccgtgcattcatgcgtgcagctggaaatgccaggacatggctgctcccacaggcagtcccgatgcaggcagctcacttgcccctggggtgcatgttctacatgatctcctggtgtcccccagtgggattaagctccagtcacccacagtggggacttgctggacattttgtagcctccttcacccccagccttcccatttccttacaagtgtttcctgggatcacctcccaaataaaatacttgggaatggaatccttttctcaggaacccaccccgagacagcatcccttgctagaggcgatgcatggagactgctgagctgacggatgggggaagagacaagggtaggaggaagacagggtgggggaggaaccggtagttaatagttcaaaatattatggcgtataattgaaaactgaaataaatggagcgcttactctgtgctgggcacagcacttggtgttttcacataacttatttcatctgaacctcctggtggctctgccccaatgccactgttcttagagatgaggaaacagtctcagggccaccctctagcaagatggttaagcagagacagaaattcaggcctactggtctcctggggaggttcctgaaattctcagctagtagaaaggttgcagcgtcttgaggtaagcctttatcttccattcctattagctcttatccgttctggcagctacctgttaatctctaaagattcctgcctttacatctttccttaaacaattagaacgtctcagattgttttgaagccaggggctcttgcagatggcctagtgtggtgaggttcataatgagaccagaggtttaggagagggacagagagtgggtgcaatggtcttctgggtcctcccttctgctcagtgatgtgctggtaaatgttgagactggctttcaggatgaaaaaaaaaaaaaaggactgacttgtagcatttgctgatttttgtggtgtcagtgcttccactgtggccagttcaagctgtgaacatgatgctactgatgctgaggttgggaagagccagaggtgtgacgttccacactgccaggaagcgttcccaccacaccagcacatcccacataaatggccccaagatccctgagaatggaagatgccatagaatccttagcagtggtgagctctgagtatgtaggagctggtgtgaactggatgtttcttccccccagctccaaatctacatgtaaaatcctcactccccatgtgatggtattaggaggtgggtcctttgggaggtggtcaggtcatgacgtggagccctcatgagtggaatgagtgccttataaaggggaccccagagagctccactggtctttccgtgatgtgagggggcagcaagaagacggccatctaggtaccaggatgcaggccctcaccaggcactgaacctgtcttggacttaaacttgatcttgaacttcccgtctccagagctgtgtgaaataaatatttgtcatttaagccacccaatctagggtatttttgttatagcagcccaaagtacttttaaaaaattgagtacctttgctcaatgaagacaatactttaaaaaaaaaattgagacagtacctgtttacaattgaggtaaaattcacataacattaaattcaccattttaactatttgaaagtgaacaattctatggcacttagtacattcatagttttacaaactaccacctctgtctggttccagaacattttcatcaccccagaaggaaacgttgtacccagttaaagcctcattccccattctccccctcctctggcaaccactataatttgttttctgtttccgtgagtttgtctattccagtttcttcatacaaatgcaattataaaacacgtgatattttgtgtctggcttctttcatgcagcatgacgttttcaaggtgcatccatgttgtagcatgtgcaagcactttgttgctttttatggctgattacgattctacggtactgtatattgccgtttgtctatccactcatcagctgatggacatttctgtcatttctctcttttgactattttgaataaagctactgtgaacatgcacgtacaaatttttgtttgaatacctgttttcaattctttggggtatatacctagacgtagaattgctggatcctatggtaatacatgtttaactttttgaggaactacccagttgtttttaaagtggctgcatcattttatatccccaccagtcgtgtttatgggttctaaattctccacatcctcaccaacacttgttattttattgcttattagtttattattattatttaccatagccatggttggtgtgaagtcctatctcattgtggttttgatttacattttcctaatagctgatgggatgaagcatctttttatgtgctttttgggcatttggagaaaaaaaatctattcaagtcctctgctcatttttaaattgggttgttacaaaaattatctgggtgtggtggtgcacgcctgtagtcccagctactcaggcggctgaggcatgagaatcgcttgaacacgggaggcggaggttgcagtgagctgagatcatgccactgcattccagcctgggcgacagagtgagactccatctcaataaataaataaataaataaataaataaattgggttgtcttttgttattgcattgtaagagttctttgtatattctggatatatcatgcatataatttgcaaatattttctcccattccgtggactgttttttcactttcttgaaagtatcctttgatgaaccaaagttttagattttgaagtcaaatttatttttcttttgctgcatgtacttttggtgtcatattttaaaatccattgcagccgggtgtggtggctcatgcctataatcccagcactttgggaggctgaggccagtggatcacccgaagtcaggagttcgagaccagcctggtcaacatggtgaaacctggtctctactaaaaatacaaaaattagctgggcatggtggcgcacacctgtaatcccagctactcaggaggccgaggcaagagaatagcttgaatccaggaggcagaggttgcagtgagctgagatcgcaccactgcactccagcctgggcaacacagcaggacgccatctcaaaaaaaaaataaaaaaataaaaaaataaaaaaatccattgctaaatccaaaaaagtcatgaggttttaatcctttgtcttctaagagttttataactttagtgcttacatttgagactgtaatcaattttaagttatccagttgtcatttatttgtttttaacattatttgattgtaagtttatgtaacgtatcttttaattagggctgtgtttcacagctggcttgcgcaatttttgaaaatttaacaatcagctctcttgagccagtatgagtggtatgagccagctcaatgtgctgctacttctatgttttttattatttttaaatttttatttatatattttttgagacagagtttcactttctcacccaggctggagtgcagtggtgcgatattggctcactggaacctccacctccaggattctagcaattctcctgccgtatcctcctgagtagctgggattacaggctcctgccaccatgcccggctaattttgtatttttagtagagacggggtttcaccgtgttggacaggctggtcttgaactcctgacctcaggtgatccgcccgcctcggcctcccaaagtgctgggattacaggcgtgagccaccatgtccagctgtgctactacttccgccacaccctgcttagaaccccttactgctaacggctggaatgtggttgttttcttggggaacggagctggggatgggtgaaatgtgcttatggagctccttggtgatgggtatctgtggaaaaaggatctggggacccctgattctctagtcacaggcctgtccagaatttccttcttgcatctggcttttcctttgtgatgtgaagagcatagctggacctctcttgctccctcccctaggatttgccaagctactcctcctggcttagagggaaccagttttgtcctaactcagtctggaggggctttggaagccccacctttgagcagagacctaagtcttgtcttgaggctgaggaagtgctccttttcctagtggtgtcaccagatcaaatacaggatgcccagccacattggaatttcagataagcagcgctcagtgtttccgtataagcatggcacgtgtgagatttgggacatacttataccaaaagtaattctcatgcaatatttgggacatactcccactaaagaactatgcattgtttatcaaatttaactgggagtcttggatttttgtttgataaatctggcaagcctttccttgcgtcagttttttttcttgctgtcttcatcctgcagcagagactcagaacctcagagtgggaaggccctgattccttgcccattttgcagatctggaaacagtcccagagaagaaaagggatttgtgcaagtgcacggaatcactgtgaacttcgaggaccttgaacaagctgcatgactttttcatgaagtcagcacactttctgagtgtctctgcatgtggcactgtgctggtgccaggggatgatggtggcaaacctgccatggacctgtgcagatggcatgttaaataagagacaggattcagacagatctgggtccaaatcccgctttgccacatgtcagcttgcatgacaagttacttcgctgtctgagcctcagctttcccttttggatgagagtaccttcctctcgcttgggatgagagtacattccttaggggattgtcaggcttccgttgggtgatgaagtgcttggtgcagggtaggcaagatttactgcatgaggagagaggagaggtgcccatggtaaagtttggttgttgtctgcaggttttccagcattgtgggccatccagatgatgcggaatggaggttccagaacccacctgccctgcccctcctgcgagggaccagccagctcccactcctggccctccaggggccccaggtggccaggcctcacctcacctgaccctgggccctgtccttctgccgccagagcagggcctggccccccccactgtgttcctgaaggccctgcccatcccactgtaccacacggtgcctcccgggggcctccagccccgcgccccgctagtgacgggcagcctagatgggggcaacgtgcccttcatactcagccctgtgctgcagcctgaagggcctggccccacccaggtggggaagccggcggcccctacgctgacggtgaacatcgtgggcactctgcctgtcctgtcgccgggcctgggccccacgctgggcagcccaggcaaggtgcggaatgcgggcaagtacctgtgtccgcactgtggtcgcgactgcctgaagcccagtgttctagagaagcacatccggtcccacacgggtgagaggcccttcccgtgtgccacctgcggcatcgcctttaagacccagagcaatctctacaagcacaggcggacgcagacgcacctcaacaactcccggctgtcctcagagtccgagggcgccgggggcggcctcctggaggaaggggacaaggccggagagccccccagaccagagggcaggggcgagagcaggtgccaggggatgcacgaaggcgcctcggagagacccctttctccgggtgcccacgtgcccctacttgccaagaacctggatgtgaggaccgaagctgctccctgtccagggtccgcatttgccgacagagaggctccttgggactctgcccccatggcgtcacctgggctcccagcggccagcacacaaccctggcgtaagttgccagagcagaagtcgccgaccgccgggaagccgtgcgccctgcagcggcagcaggcgacggcagcggagaagccctgggatgccaaggcccccgagggccggctgcggaagtgtgagagcaccgactcggggtacctgtcgcgctccgacagcgcggagcagccgcatgcgccctgcagccccctgcacagcctttcggagcacagcgccgagtccgagggggagggcggcccgggcccggggccaggggtcgcaggggccgagcccggggcgcgagaagccggcctggagctggagaagaagcggctggaggagcgcatcgcccagctcatctcccacaaccaggcggtggtggacgatgcccagctggacaacgtgcggccccggaagaccgggctgtccaaacagggcagcatcgacctgcccacgccctacacctacaaggactccttccactttgacatccgcgcgctggagccaggccgtaggagggccccgggccccgtgcgctccacctggacgcccccagacaagtctcggcccctcttcttccactccgtccccactcagctctccaccaccgtggaatgtgtccccgtcaccaggagcaactcgctgcccttcgtcgagggctccaggacgtggctggagcccagggagccccgggacccctggtccaggacgcagaagcctctgagccccaggcccggcccagcccgcctgggctgccgctcgggactaagctcgactgacgttcccagtgggcatccccgggccctggtcagacaggccgcggtggaggacctgccaggcacccccattggcgatgccctggtgcccgcagaggacacagacgcaaagagaactgctgcgcgggaggccatggccggcaagggcagagcgggcggcaggaagtgcggccagagaaggctgaagatgttctcccaggagaagtggcaggtgtacggggatgagacgttcaaaaggatctaccagaaaatgaaagccagtccccatggaggcaagaaagccagggaggtgggaatgggcagtggggcagaactgggctttcctctgcagaaagaggcagcagggagctcaggcacagtccccacccaagacaggaggacccctgtccatgaggacatatccgcaggggcaacgccagagccttggggaaatccaccagccctggaggcctccttggtgactgaacccactaagcatggggagacggtggccaggagaggagacagtgaccgacccagggtggaagaggctgtgtcatcccctgcactgggtggcagagacagtccctgttcaggcagtaggagccccctggtctctccaaatgggaggctggaactggggtggcagatgcccccagcacctggccccctcaaagggggtgatgtagaggctcccaggccagtttggccggaccccaagctggaaggaggtgcccgaggtgtgggggatgttcaggagacctgcctgtgggcccagactgtcctgagatggcccagcaggggctcaggggaggacaagctcccctcagagaggaagaagctgaaagtggaggacctgcacagctggaagcaaccagagcctgtgagcgcagagaccccaggtgggcccacgcagcctgcctctttgtcatcccagaagcaggatgccgatcccggggaggtgccagggggctcaaaggagagtgccaggcaggtgggcgagcctctggagtcctctggagcctccttggctgctgcttctgttgccctgaagagggtggggccaagggacaaggctaccccactgcatcctgcagccccagcccccgcagagcacccctcgctggccaccccacctcaggctcctagagtgctctctgccctggcagataatgccttttcccccaagtacctcctcaggttacctcaggcagagacccccttaccactgcccattccctggggaccaaggcacagccaggactctctctgcagcagtgggtggcctgaagaacgggcatcatttgttgggtcaggactggggacccctctttctcccagcccagcctcaggcccctccccaggtgaggcggacagcatcctggaggaccccagctgttccaggccacaggatgggagaaaaggggcacagttggggggggacaagggggacaggatggccactagcaggccagcagccagggagttgcccatctcagcaccaggggctcccagggaggctacctcctccccgcccactccaacgtgtgaggcacacttagttcaggacatggagggtgacagccaccgtatccatcgcctctgcatgggcagcactttggcaagggccaggctctctggggatgtcctgaatccctgggtacccaactgggagctgggggagcctcctgggaatgccccagaagatccttcttcagggcccctggtgggccccgacccgtgttcccccctccagcctggctccttcctcactgccctcactcggcctcagggtgtgcccccaggctggccagagctggccttgtcttcccactcagggacgtcccggagccacagcacccgcagtccccacagcacccaaaacccctttccctcactgaaggctgagccgcggctcacgtggtgttgcctgagccgcagtgtccctctgcccgcggagcagaaggcaaaggcggcatctgtgtacttggcggtgcactttcctggtagcagcctccgagatgagggtcccaatggccctcctgggagcaatggaggatggacctggacaagccctggagaaggagggccggcgcagatgtccaaggtaaagctgggctttgccccagggcccggggttgagagagcatgttgttatcccgtaagacctctcatgagggaaggaagtctgaagccgtcccatgtagcatctgctgttcactgcttgcttgttcctgagggaggctggggataccacatagacagcaggaaggaataaaggcccaaatgcaaaccaaaacagagttgcggaaaacataaattccaaaggaaagaattactgtactcaagacatgaggtgagatagtcttcataaccaaatgtaaaatttaactgagcttcctggtaacagaagcaaaaagtaaaatgaaacactccatcagagaggtgagctctctggatcattctaagattataagccagagactcccaataattgagagagtctttatactggggattctggagaaggaattactgttgattggactcagccctctctctgaggttcctgggggcagagagaaaagggggaaatgtggtggatgctcacaggtgttctcacttggtgaagaaatgataatgcagagctccaccttgagagggggttcacgcacctggttgtgatgactgagggcttagtcctgctctggagtggcttgggccgcggccactgaggacggtcctggaggctcagcagtcatttaacctttgtggacagtgacaaaggcccggagaccagagtcttgcaggctgttcggctttccctaggtggaacccaaagttgtggggagtgctgttttcatcttgagagtagcgggttagtcagtagggccccaggggtgtgggggctcccggggaggtggatttaggggatagtaaaggggctggtcaccgtgtttctttggcctccagttaacaccgatggcataggctttcctctgcggatcaagcccaggcggggtttcaggaggttctgtccaggaacgctctgccgttgcctggttgaacttctcaggggctcagcccgtttagcaatgcagtatttccgttttgatttctgaagacaggcatcttgtctgcagagcgagaaccctttggagttttcttcatcatgaggactttgagtaatgtgatgccaacatgcttggtgttttcagttctcctacccaacagtcccaggggtgatgccccagcaccaggtgtctgagccagaatggaagaaaggcctgccttggagggcaaagatgtctcgtgggaacagcaagcagagaaaactgaagatcaaccctaaaaggtaggatgagtggccacctctgtcatttccacaaaaccccaagaagaatttactatgggatttgaaaggtatccgtgtgctccagagaaagagttcctgtttcctagggtttagagcttcatgattaaaggactgaatttgtttcccaccccttgcaactcaccgcctgtgtattttttgatggcacctttctaaggccaggaatccagcaaatctttgaaataactgggttgaaaacacatccattcaacttaagtctggaagagagagagcctgttaattatttacagcttttattgtgtttttaattatgcaagcaatgaatgtcctttgcagaaaaatttgacaatacagatgagcaaagagaagacaataaaacatcctagtaatctcgccacgcagagataatcaccgtgaacattcaggagtgtgcccttctagacttttctttgcggtatgtgtttgcacatatccacccccaacaaacaggaggccctgtggattttcctgccactctttcattgtgcctttcttggattgtctttctcctttgcttaaaacccttcaggctgcccgttgcatacaagttgaaaagcgaattctctaacccctgccctctttctaccctcattttccctgtgatctcctcctctcctgctcgccctccaccctcatcccattctctaatccacattctaatcccagatccctgaagcatttatactccacacctcagttgtcaacctgtcaacattctcccccagactgtcagtccttttttttcttttttgagactgagtctgactctgttgcccaggctggagtgcagtggcgtgatctcggctcactgtaacctctgccttgggggttcaagcgatttgcctgctcagcctcctgagtagctgggattacaggcatgggccaccacgcccagctattttttttttttttttgtatttttagtagagacggggttttgccatgttgcccaggctggtctcaaactcctggcctcaagcgatcctctcgtcttggcctcccaaagtgctgggattataggcggtgagccactgcactgtcagtaatttatccaaagcctggatattcttcaaggggcgatccaaattcctaactttcccctgtagctgctcagaccctcagtggctagagatggcctcttctcttttggttccccctcctgccctgcctctatcaatggtctgccgggaccatgtgtccagagctaacattatggggcacttgctgtgtgccagactttccctaatcgctttctggcatgcattgtttcaggagatcccacaaggtactgcccatgatgtggatggtattattagccccatttttctcatgaggaaatggagacacagagagcttagataacctacccaaggacccagatttgaaccagccggtctccttccatagcctgtgtgccagctagtcgcttgtcttggtgcaccccagcctgtcctgggcacgctagcggcctggcattttctagatttttcttgcaatgcttgagattttgcatttctgacacagccaggtgatggtgctggcgtggcccccagagcaggcttgggggagtggggctttcctttccagcgtccctcctttctcatggatcactcagggtcctgagacagaagcctgactcaaggtagtctgaacaaaacaaggcctccctgcctgtgtaatggggcctctaagcctcatcatcagccctggcccaaacttggtggtgtgggaaggacagtcttccaaaggaaaattcgagtgctgctcttggaggaaaggggaatgcatgccatccagacggaggagctgcatgcggggctctgggaaacaagggacatcggctagtggttgtggtcctcctcagtatctcaccaataaggaggaagtgctcagttacatgtgactgatagttgatgagcctgaagcctccaggcatcattggaaagatgtggggagagggaagaggatgggttgcctcattaacagctcccactttcccaagacttcagcttgactaattcgaaaatatttaccatgtacctgctgtgtgcctggtgcccacacctggaggtggccgaggaaactttcttaatccagggtgagggtcccagactggagcccaggaggcttggagatatcactccaggacaccttgcaaacccactagcagctcttgggccaaacacagtgcatgtaagacccttattaggccagtgctctaaaacttttggcacttagcagccacataattagatgtaaagatttctcataaaaatctggatttctaacttttcttgaaatatgggaagctctgaagacactgggcctgcctccttacatggcaacagccagatggagatgagcagtggccaccccttgtgggtaagagctgtgttccctgctgcgctctctagctcacctctccctaatgtcttaccctcggccagcctctctcagttatgctctctgcctggcccccatagcatttgagtttgcaaattttggccttactagctggccttgtggaactagacggcctctccactcaacaaatcacgacaagagcccatggatgggcacaggaaggggcaggggcattgcagaacagggaggagtctgaacaaggacttagagctctaaccaagagctcctggctgggtcaaatgaggaggaagctgttgagctttttatatgcacaaacgtttattggttgatagtgatttgtttatcattggtccttttgttggctcatgactgtcttttgagttaattccagcttcaaggcctttgcacctgctagtccctctacctccatctgcacactcctcctcttgctcctcacatggctggctcccctgtctcagaaaaagcatcagcaccatgagggcatggatatctaggcatggacgtctttgaggggaggtattactctgcctaccacactgtttatccaaccacccacacacatatgtttgtagatatttatctgtccatctgcccacccacccacccacccatcaacttacatatctatctatctatctatctatctatctatctatctatctatctatctatcacgtaactccttgtgttctctcctcaagaaggaagcctacttcttgattcattttcccactttaatttcagttgtcttaatgttctacagaaaatgaaatactgtagcagagattgctctatagtccttagctcacagagaatgatacagttctcttctaagtaaaatattaccttaaatgttatataacaatatatagaaaagaaaaatttaaaagattattatgttgttttatgtatttggcacaaatcatatcaatctgtgttttcatactttgcaaatcaccaataatatataatattgtttggtgtctttaaagtacacataaaagtatcatagttatttatcatttatcattcttcagcttgatttttaaggtcaacattgtgtttttgaagatctcatcgtgtcaggacatactgatcaaattcattcattctgattgctgtagagtgtctcatccatgagtaagagtttgcccttcattcatatgcttcctaatatttgttgttatcagattttttaagtgatgaatataatttataggattctatatatatcctagatttgtatgtattatttgcctgttatatatactgcaaatatgtttccaagtctattacttgtctttttaagcccctttatttatatgtacccacataattgcccatctcttgtcttttcatttgtttctgcatgtcagatcttccttctgggattattttcttctacctaaatcatattctttagaatttcctttattagagaaggaaattctcttagtttttattactctgcaaatatatttatttcatcattgttgttgaaaaatagtttgctgggtacacaattctaggttgactgttattttctcagcacatcaaagctaccattgcactatctgtcagcttccattttgtggtaaagaaagccagctgttagactactcatctgtcttttgaaagtcttttatctctggctacctttaagatcttcttttatcctttggtgttccatagttttactttgatgtatatagatgtatgttgctttttatttgttccattaggaatccacagggctattttgatttgtggattggtgtctctctgtaaaaaattcttagccatcattctccaaatattgcctctgtcctgttccctctccttcctttctgaaatactgaaataatatatattagtccttttctatctttcatgtcttttaatacttttaataaccttgtttctctgtgctataatctggatactttgttcaaatctgtctttaaaattttaccagtttttaaatctactattttttgtaaagctttattaaagtataattaaattttaataaattgcacatatttaaaacatacaattaaataaattttgacatatatatatacctgtgaaacaatataaccaggatcatgaacatatctgtcaagcccaaaagtttcctcctatccttttgtaattcctcccttctgcccgtcctgaagtccttccatccccaggtaaccgctgatgtgctttctgtcacataggatagtttgccttttctagaattttatagaaacagaatcatacaatatatgctctcttttttttgcctggctttattcactcagtattactattttgaggttcatccatgttgtgtttatcaagaacacattccttcttattgctaactagtatgccattgagtgagtatgtcacaatttgtatacatgttcacttgttgatagacatttggtttgtttcagtttggggctattacaaataaaatgactataaatattcatatgcaaacctttgtatggacatatgctttaaattatcttgggaaaatacctagaggtgaaaagcctggatcatatggtagatgtattattaacttttaaagaagctgccaaattgttttccaaagtggttgtattattttacatctccactatcagagtatgagagttccatttctctacattattgccaacacttggtatggtaattttttttagttttagtcatttgaatagttatgtagtggtatctctttatagcttgaatttgcatttccctaacaagtgatgatattcagcatctttttttgtgtgcttatttagcatttgtatatcttctctggcgaagtgtctcttcaaatcttttgcgcatcaaaaatgggttgttttcttattgagttttgagaatttttttaatatactctgattataagttccttatcggagatgtgatttgtaactattttctttcaatctatggcttatctttctattcttttagtagcatcttttaaaaagcaactgtctttcactttgatgatatttaatttacctttttttgttatgtttttagtgtcatagtttaaaaaagtgtgtctaaacagagcttcaaagcttttcttctaaatttttctctaaagttttatacttttaagttttatatttaggtctataattcattttcacttagtgtttacatatggtgtgatgtatggatcgaagttcttatttttgtgtgtggatatcttatctagttgttccagcatcatttgttgatctatttgtctatttcaatgcaaataccacactgacttgattacgccgcttgactctgagacttattataaagctaaagtattccaaagagtgtggtttttgcatcaaaatggatacaaagatcaatggagcaaaatagagaatacagaaatagaccatgctgtggtcaattgatttttcatacaggctcaaaggaaattcagcggaaaaagtatagtcttttcaacaaatggttccagacctggaaaatttctccatcaataagttgaggtgtcatcaggcttacctcatctgtttctcttctttcatggatcactgcctttattgctcaatgtccaatgccctgaacactattgttttgtatctttattcagttttttacttgggatggtaaatctggttacttttgcaaagtcttggtcagaagtccctggcctattgcagtgcctcctagttgatctcccctacttttattggtctgctaaagtttaagttcaattgttgatgtgaattatattttatttccaaaaagttttatttaattatttttttaatttgcttgatcattttatagtctcttgcacttgactcttattttcaacctttttttttttttttaaaaaaaaaaacacatctaatgttttgcatctgacaatgacaacctatgaagtcttggcacatctgactctgttttatatatttgctctcacatatgttaacttatttccttgtttgtgttaaaatttttgactgtgagttgatatttttggaactttgagatgtgggttgaaggtggattcctccaataaatatttgttttgcttccactgggtgcctgggggtgctcgtttgtttgttgttatgttccccgggcaggtggtggggtagggagtatttatttctaattcacccacatactgagagtatgcctttcagaggtctcagctttatgcaggaaaggaggttgggtcttccatgtgcctctcactgaagaacattctgggctttgagtcctgtaccctcagctgcaccagagcatgaaaataggaaggtcatcctcatctggtttggcagattcctcaaagtgaaagcaatctcacttttccagggcgcagctctcacttggtttttgcctttgaactatttcttatcttttaatcagaacatacgtaaatttaaatataagtttaaaaaatgtttacattttacgctgcatttttaattgttttcagtataaggataaatttggtggtaatcagtcagagtattgagtccactgtgctgttggaaatggagttcttattttttaaccttgataatgatggttttttcattaagaatttgtaaattttgatgtagtcaaatggggctgtcttttcatgactttttggtatatctaagaaatctttctttactctcaatttcctactttcaaaaatatgcagatatgttatcttatgttttcttcttgtatgaattcatatatatagaaggatttatttttatttttgtttataaagacaactatggaccacgggttaaatatggtttttaacttattttaaccatgagcaacgcattatttatatacatatatatttgatcgacagggtctcactatgttgcccaggctgcagggcagtggctattcacaggtgtgatcatagcacaccacagcctcacactcctggcctcagtggtcttcctgcctcagcttctggagtagctgggagtacaggcatgcaccaccatgcctggcttggtttttatatttttaaaagcttatccatataaaaacagaagaagaatacgtggcacagattgtctgtggcatacaaagtctaaaatatttattagctggacctttgcataaaaatcaagcagacccctgcattaatccacttttgcccacttacatgttaaattttagcttcccgtttatacttgaagtttttttcagggcctttcattctgctttcattcatctctatgttttttgccaactgcaaataccacactgtaatgaaaatggttgttttcattaacaaaactacatgagttaaagaagagagattagaaaatgcaggatccacttccagagtggaaatggaaaaacgcagaaaattcatactcagaagcctaattgccctgacattaactagaggcatagagatccggagcactcacaaaatacctccctgccttgcccaaagcaagcgcgggatcatggaattagattttattgattaatttataactgtgtactgtgctgtatgaagcatgaaacattcagagacttgttcctaggaagcttccaacaaatggaacaatgaattgtgaagccccaagtgaatggaaatgagcgaggagaagattgcaggttgtatgggagaagggcactctataaaaccctaaaatatacattagtcgttgaaggggagagtggagaagaaaaaaatcctgggctttgagaatgcaattctattagcagatagtgtttttccttatggagcggatgtttatctgtctaagccatgtgtctattcactttagtcatcacacaatttacttattcaatgagatagcactctcagtaatgagagcacaatctctgcagtgaggtaaagacaaagacctacagatgtggccctgagtccacgtggcctctgctgcatgtgacccccaccacatgtggctgagactctttgtcacgttggccacagccccagagctttgacagcagtcccaggtcctgcttagcaggatacagaggctctgccatccacacctccactgctcttctctttgctttgttcttctctgtggggtcaagagaggaaagtgagggaaatagcacgtcagatctcatagtttcgccccagaaaggaatgtgtgtggagtgggctgtgtacacctgcaagagccactccttgggtctactgtccttccctgagagagcctgacaaaggtggcaagggggtgacgagtgtatcaccctcacagccgggtgcggaggtgcagcctgacgaaagtgtcctggatggggccccaacagcactggccacaccttgaggggacttgcatggctggtgatggagatgagcttgcaaaaccttcctaagccaggatgctgcttctccaggaggggctgcacacagaacgttttgggagaaccaggagagagagaaacgtaccctgcccatgactaaactaaacagtcctttgaagacattgccaaggtccacttgggctgttctcgaaggcaaaaagtttgaaattccaccttgatgaagtgcgaattcagaggcggggcctttcctagctctctccttgttattttgcgtgaggagaaagacccccgcttgctaattttctgaaagtaaaacctccctgcagttcaaactgtgccgttcttaacacctgcaagtgtgtggcagccacccactgacttgcgcaaaggtgacccagcagcaggtggaagaagaattctctccatgtgccaccccttccttcctccctttgtctctgcactttgaaatctctctccacccaggccctgcaggatttggttcaggggtttgtcgctccccaccctggctcagatagctctttcaggaacctgtgttcttgacaactgcttcaaagaacaaaccagccaccactgcctcccccaccaaactaacctcccctccccccagccggggaatgacagctcctgccccagacaggggaggcaatcatgcccagttgaggggagcttctcccaaacacagaggccggaaaagatgaacaaaatgtcactttctcattgttgctgccaggaaaaaccagtgcccaagaggatactgcattctgtagatcttatttaaaattttgtgagcggccctggtgattaggggactgcggctggatcttggcggtggctcagataaatgagaaaggaaaatagccggttctgaggagcactgtggagtagaaatattgtaaactgaggcttgtaaagggaagggattacttgtggcttgaccaggcagttagaagcagtgcaaagatcttctaaaagagcttaaggcatattgcaggcctggctcttcgtctcattcttttgcctatataatgggggtgctatactaggttgatggcctgtttgtggttgcacattcctattagtaaaataatttgtagcctgcacctattaaatgtgtatttgttcatttacaaattatacatatattctgctctatgacatgaaacaatagaaacaagaaaggacatgaaacaatagaaataagaaagact

SEQ ID NO: 2057 - DNA, 3857 bp, Homo sapiens
atggaggttccagaacccacctgccctgcccctcctgcgagggaccagccagctcccactcctggccctccaggggccccaggtggccaggcctcacctcacctgaccctgggccctgtccttctgccgccagagcagggcctggccccccccactgtgttcctgaaggccctgcccatcccactgtaccacacggtgcctcccgggggcctccagccccgcgccccgctagtgacgggcagcctagatgggggcaacgtgcccttcatactcagccctgtgctgcagcctgaagggcctggccccacccaggtggggaagccggcggcccctacgctgacggtgaacatcgtgggcactctgcctgtcctgtcgccgggcctgggccccacgctgggcagcccaggcaaggtgcggaatgcgggcaagtacctgtgtccgcactgtggtcgcgactgcctgaagcccagtgttctagagaagcacatccggtcccacacgggtgagaggcccttcccgtgtgccacctgcggcatcgcctttaagacccagagcaatctctacaagcacaggcggacgcagacgcacctcaacaactcccggctgtcctcagagtccgagggcgccgggggcggcctcctggaggaaggggacaaggccggagagccccccagaccagagggcaggggcgagagcaggtgccaggggatgcacgaaggcgcctcggagagacccctttctccgggtgcccacgtgcccctacttgccaagaacctggatgtgaggaccgaagctgctccctgtccagggtccgcatttgccgacagagaggctccttgggactctgcccccatggcgtcacctgggctcccagcggccagcacacaaccctggcgtaagttgccagagcagaagtcgccgaccgccgggaagccgtgcgccctgcagcggcagcaggcgacggcagcggagaagccctgggatgccaaggcccccgagggccggctgcggaagtgtgagagcaccgactcggggtacctgtcgcgctccgacagcgcggagcagccgcatgcgccctgcagccccctgcacagcctttcggagcacagcgccgagtccgagggggagggcggcccgggcccggggccaggggtcgcaggggccgagcccggggcgcgagaagccggcctggagctggagaagaagcggctggaggagcgcatcgcccagctcatctcccacaaccaggcggtggtggacgatgcccagctggacaacgtgcggccccggaagaccgggctgtccaaacagggcagcatcgacctgcccacgccctacacctacaaggactccttccactttgacatccgcgcgctggagccaggccgtaggagggccccgggccccgtgcgctccacctggacgcccccagacaagtctcggcccctcttcttccactccgtccccactcagctctccaccaccgtggaatgtgtccccgtcaccaggagcaactcgctgcccttcgtcgagggctccaggacgtggctggagcccagggagccccgggacccctggtccaggacgcagaagcctctgagccccaggcccggcccagcccgcctgggctgccgctcgggactaagctcgactgacgttcccagtgggcatccccgggccctggtcagacaggccgcggtggaggacctgccaggcacccccattggcgatgccctggtgcccgcagaggacacagacgcaaagagaactgctgcgcgggaggccatggccggcaagggcagagcgggcggcaggaagtgcggccagagaaggctgaagatgttctcccaggagaagtggcaggtgtacggggatgagacgttcaaaaggatctaccagaaaatgaaagccagtccccatggaggcaagaaagccagggaggtgggaatgggcagtggggcagaactgggctttcctctgcagaaagaggcagcagggagctcaggcacagtccccacccaagacaggaggacccctgtccatgaggacatatccgcaggggcaacgccagagccttggggaaatccaccagccctggaggcctccttggtgactgaacccactaagcatggggagacggtggccaggagaggagacagtgaccgacccagggtggaagaggctgtgtcatcccctgcactgggtggcagagacagtccctgttcaggcagtaggagccccctggtctctccaaatgggaggctggaactggggtggcagatgcccccagcacctggccccctcaaagggggtgatgtagaggctcccaggccagtttggccggaccccaagctggaaggaggtgcccgaggtgtgggggatgttcaggagacctgcctgtgggcccagactgtcctgagatggcccagcaggggctcaggggaggacaagctcccctcagagaggaagaagctgaaagtggaggacctgcacagctggaagcaaccagagcctgtgagcgcagagaccccaggtgggcccacgcagcctgcctctttgtcatcccagaagcaggatgccgatcccggggaggtgccagggggctcaaaggagagtgccaggcaggtgggcgagcctctggagtcctctggagcctccttggctgctgcttctgttgccctgaagagggtggggccaagggacaaggctaccccactgcatcctgcagccccagcccccgcagagcacccctcgctggccaccccacctcaggctcctagagtgctctctgccctggcagataatgccttttcccccaagtacctcctcaggttacctcaggcagagacccccttaccactgcccattccctggggaccaaggcacagccaggactctctctgcagcagtgggtggcctgaagaacgggcatcatttgttgggtcaggactggggacccctctttctcccagcccagcctcaggcccctccccaggtgaggcggacagcatcctggaggaccccagctgttccaggccacaggatgggagaaaaggggcacagttggggggggacaagggggacaggatggccactagcaggccagcagccagggagttgcccatctcagcaccaggggctcccagggaggctacctcctccccgcccactccaacgtgtgaggcacacttagttcaggacatggagggtgacagccaccgtatccatcgcctctgcatgggcagcactttggcaagggccaggctctctggggatgtcctgaatccctgggtacccaactgggagctgggggagcctcctgggaatgccccagaagatccttcttcagggcccctggtgggccccgacccgtgttcccccctccagcctggctccttcctcactgccctcactcggcctcagggtgtgcccccaggctggccagagctggccttgtcttcccactcagggacgtcccggagccacagcacccgcagtccccacagcacccaaaacccctttccctcactgaaggctgagccgcggctcacgtggtgttgcctgagccgcagtgtccctctgcccgcggagcagaaggcaaaggcggcatctgtgtacttggcggtgcactttcctggtagcagcctccgagatgagggtcccaatggccctcctgggagcaatggaggatggacctggacaagccctggagaaggagggccggcgcagatgtccaaggggtgatgccccagcaccaggtgtctgagccagaatggaagaaaggcctgccttggagggcaaagatgtctcgtgggaacagcaagcagagaaaactgaagatcaaccctaaaaggtag

SEQ ID NO: 2058 - protein, 1247 aa, Mus musculus or Homo sapiens [sequence omitted]

SEQ ID NO: 2059 - protein, 5 aa, Unknown
  cytokine receptor extracellular motif found in many species
  VARIANT (3)..(3): "Xaa" at position 3 can be any amino acid
WSXWS
